United States Patent
Xiao et al.

(10) Patent No.: US 9,765,157 B2
(45) Date of Patent: Sep. 19, 2017

(54) ANTIBODY CONSTRUCTS FOR CDH19 AND CD3

(71) Applicants: AMGEN INC., Thousand Oaks, CA (US); AMGEN RESEARCH (MUNICH) GMBH, Munich (DE)

(72) Inventors: Shouhua Xiao, Foster City, CA (US); Zheng Pan, Fremont, CA (US); Dineli Wickramasinghe, San Francisco, CA (US); Peter Kufer, Munich (DE); Patrick Hoffmann, Munich (DE); Tobias Raum, Munich (DE); Ralf Lutterbüse, Munich (DE); Elisabeth Nahrwold, Munich (DE); Claudia Blumel, Munich (DE)

(73) Assignee: AMGEN RESEARCH (MUNICH) GMBH, Munich (DE)

(*) Notice: Subject to any disclaimer, the term of this patent is extended or adjusted under 35 U.S.C. 154(b) by 0 days.

(21) Appl. No.: 14/815,861

(22) Filed: Jul. 31, 2015

(65) Prior Publication Data

US 2016/0032019 A1 Feb. 4, 2016

Related U.S. Application Data

(60) Provisional application No. 62/031,770, filed on Jul. 31, 2014.

(51) Int. Cl.
*C07K 16/46* (2006.01)
*C07K 16/28* (2006.01)
*A61K 47/48* (2006.01)
*C07K 16/30* (2006.01)
*A61K 39/00* (2006.01)

(52) U.S. Cl.
CPC ...... *C07K 16/468* (2013.01); *A61K 47/48215* (2013.01); *C07K 16/28* (2013.01); *C07K 16/2809* (2013.01); *C07K 16/2896* (2013.01); *C07K 16/30* (2013.01); *A61K 2039/505* (2013.01); *C07K 2317/21* (2013.01); *C07K 2317/30* (2013.01); *C07K 2317/31* (2013.01); *C07K 2317/33* (2013.01); *C07K 2317/622* (2013.01); *C07K 2317/73* (2013.01); *C07K 2319/00* (2013.01)

(58) Field of Classification Search
CPC ............. C07K 16/468; C07K 16/2809; C07K 16/28096; C07K 2317/31; C07K 2317/30
USPC ............. 424/136.1; 435/252.33, 320.1, 328; 536/23.4
See application file for complete search history.

(56) References Cited

U.S. PATENT DOCUMENTS

| | | | |
|---|---|---|---|
| 3,691,016 A | 9/1972 | Patel et al. | |
| 3,773,919 A | 11/1973 | Boswell et al. | |
| 3,969,287 A | 7/1976 | Jaworek et al. | |
| 4,179,337 A | 12/1979 | Davis et al. | |
| 4,195,128 A | 3/1980 | Hildebrand et al. | |
| 4,229,537 A | 10/1980 | Hodgins et al. | |
| 4,247,642 A | 1/1981 | Hirohara et al. | |
| 4,301,144 A | 11/1981 | Iwashita et al. | |
| 4,330,440 A | 5/1982 | Ayers et al. | |
| 4,439,196 A | 3/1984 | Higuchi | |
| 4,447,224 A | 5/1984 | DeCant, Jr. et al. | |
| 4,447,233 A | 5/1984 | Mayfield | |
| 4,475,196 A | 10/1984 | La Zor | |
| 4,485,045 A | 11/1984 | Regen | |
| 4,486,194 A | 12/1984 | Ferrara | |
| 4,487,603 A | 12/1984 | Harris | |
| 4,496,689 A | 1/1985 | Mitra | |
| 4,544,545 A | 10/1985 | Ryan et al. | |
| 4,596,556 A | 6/1986 | Morrow et al. | |
| 4,640,835 A | 2/1987 | Shimizu et al. | |
| 4,670,417 A | 6/1987 | Iwasaki et al. | |
| 4,751,180 A | 6/1988 | Cousens et al. | |
| 4,790,824 A | 12/1988 | Morrow et al. | |
| 4,791,192 A | 12/1988 | Nakagawa et al. | |
| 4,816,397 A | 3/1989 | Boss et al. | |
| 4,816,567 A | 3/1989 | Cabilly et al. | |
| 4,935,233 A | 6/1990 | Bell et al. | |
| 4,941,880 A | 7/1990 | Burns | |
| 4,946,778 A | 8/1990 | Ladner et al. | |

(Continued)

FOREIGN PATENT DOCUMENTS

EP 0036676 A1 9/1981
EP 0058481 A1 8/1982
(Continued)

OTHER PUBLICATIONS

Ward et al. (Nature 341:544-546 (1989)).*
Smith-Gill et al. (J. Immunol. 139:4135-4144 (1987)).*
Kumar et al. (J. Biol. Chem. 275:35129-35136 (2000)).*
Song et al. (Biochem Biophys Res Comm 268:390-394 (2000)).*
Aplin et al., Preparation, properties, and applications of carbohydrate conjugates of proteins and lipids. *CRC Crit. Rev. Biochem.* 10(4): 259-306 (1981).
Arakawa et al., Protein-solvent interactions in pharmaceutical formulations. *Pharm. Res.* 8(3): 285-91 (1991.).
Artsaenko et al., Expression of a single-chain Fv antibody against abscisic acid creates a wilty phenotype in transgenic tobacco. *Plant J.* 8(5): 745-50 (1995).
Brühl et al., Depletion of CCR5-expressing cells with bispecific antibodies and chemokine toxins: a new strategy in the treatment of chronic inflammatory diseases and HIV. *J. Immunol.* 166(4): 2420-6 (2001).
Carter et al., High level *Escherichia coli* expression and production of a bivalent humanized antibody fragment. *Biotechnology (NY)* 10(2): 163-7 (1992).

(Continued)

*Primary Examiner* — Lynn Bristol
(74) *Attorney, Agent, or Firm* — Marshall, Gerstein & Borun LLP

(57) ABSTRACT

The present invention provides a bispecific antibody construct comprising a first human binding domain which binds to human CDH19 on the surface of a target cell and a second binding domain which binds a human CD3 on the surface of a T cell. Moreover, the invention provides a polynucleotide encoding the antibody construct, a vector comprising the polynucleotide and a host cell transformed or transfected with the polynucleotide or vector. Furthermore, the invention provides a process for the production of the antibody construct of the invention, a medical use of the antibody construct in the treatment of melanoma, and a kit comprising the antibody construct.

14 Claims, 6 Drawing Sheets

(56) References Cited

U.S. PATENT DOCUMENTS

| | | |
|---|---|---|
| 5,013,556 A | 5/1991 | Woodle et al. |
| 5,064,413 A | 11/1991 | McKinnon et al. |
| 5,223,409 A | 6/1993 | Ladner et al. |
| 5,225,539 A | 7/1993 | Winter |
| 5,292,658 A | 3/1994 | Cormier et al. |
| 5,312,335 A | 5/1994 | McKinnon et al. |
| 5,383,851 A | 1/1995 | McKinnon, Jr. et al. |
| 5,399,163 A | 3/1995 | Peterson et al. |
| 5,418,155 A | 5/1995 | Cormier et al. |
| 5,476,996 A | 12/1995 | Wilson et al. |
| 5,545,806 A | 8/1996 | Lonberg et al. |
| 5,545,807 A | 8/1996 | Surani et al. |
| 5,565,332 A | 10/1996 | Hoogenboom et al. |
| 5,569,825 A | 10/1996 | Lonberg et al. |
| 5,585,089 A | 12/1996 | Queen et al. |
| 5,591,669 A | 1/1997 | Krimpenfort et al. |
| 5,612,205 A | 3/1997 | Kay et al. |
| 5,625,126 A | 4/1997 | Lonberg et al. |
| 5,625,825 A | 4/1997 | Rostoker et al. |
| 5,633,425 A | 5/1997 | Lonberg et al. |
| 5,643,763 A | 7/1997 | Dunn et al. |
| 5,648,260 A | 7/1997 | Winter et al. |
| 5,661,016 A | 8/1997 | Lonberg et al. |
| 5,683,888 A | 11/1997 | Campbell |
| 5,693,761 A | 12/1997 | Queen et al. |
| 5,693,762 A | 12/1997 | Queen et al. |
| 5,698,767 A | 12/1997 | Wilson et al. |
| 5,721,367 A | 2/1998 | Kay et al. |
| 5,741,668 A | 4/1998 | Ward et al. |
| 5,770,429 A | 6/1998 | Lonberg et al. |
| 5,777,079 A | 7/1998 | Tsien et al. |
| 5,789,215 A | 8/1998 | Berns et al. |
| 5,789,650 A | 8/1998 | Lonberg et al. |
| 5,804,387 A | 9/1998 | Cormack et al. |
| 5,814,318 A | 9/1998 | Lonberg et al. |
| 5,859,205 A | 1/1999 | Adair et al. |
| 5,874,299 A | 2/1999 | Lonberg et al. |
| 5,874,304 A | 2/1999 | Zolotukhin et al. |
| 5,876,995 A | 3/1999 | Bryan |
| 5,877,397 A | 3/1999 | Lonberg et al. |
| 5,925,558 A | 7/1999 | Tsien et al. |
| 5,939,598 A | 8/1999 | Kucherlapati et al. |
| 5,958,765 A | 9/1999 | Brams et al. |
| 5,981,175 A | 11/1999 | Loring et al. |
| 6,023,010 A | 2/2000 | Krimpenfort et al. |
| 6,075,181 A | 6/2000 | Kucherlapati et al. |
| 6,114,598 A | 9/2000 | Kucherlapati et al. |
| 6,150,584 A | 11/2000 | Kucherlapati et al. |
| 6,162,963 A | 12/2000 | Kucherlapati et al. |
| 6,255,458 B1 | 7/2001 | Lonberg et al. |
| 6,300,064 B1 | 10/2001 | Knappik et al. |
| 6,407,213 B1 | 6/2002 | Carter et al. |
| 6,673,986 B1 | 1/2004 | Kucherlapati et al. |
| 2003/0070185 A1 | 4/2003 | Jakobovits et al. |

FOREIGN PATENT DOCUMENTS

| | | |
|---|---|---|
| EP | 0088046 A2 | 9/1983 |
| EP | 0133988 A2 | 3/1985 |
| EP | 0143949 A1 | 6/1985 |
| EP | 0171496 A2 | 2/1986 |
| EP | 0173494 A2 | 3/1986 |
| EP | 0239400 A2 | 9/1987 |
| EP | 0463151 A1 | 1/1992 |
| EP | 0546073 A1 | 6/1993 |
| EP | 0773288 A2 | 5/1997 |
| EP | 0843961 A1 | 5/1998 |
| GB | 2177096 A | 1/1987 |
| JP | 3 068 180 B2 | 7/2000 |
| JP | 3 068 506 B2 | 7/2000 |
| JP | 3 068 507 B2 | 7/2000 |
| WO | WO-87/05330 A1 | 9/1987 |
| WO | WO-88/09344 A1 | 12/1988 |
| WO | WO-92/03918 A1 | 3/1992 |
| WO | WO-92/15673 A1 | 9/1992 |
| WO | WO-92/22645 A1 | 12/1992 |
| WO | WO-92/22647 A1 | 12/1992 |
| WO | WO-92/22670 A1 | 12/1992 |
| WO | WO-93/12227 A1 | 6/1993 |
| WO | WO-93/15722 A1 | 8/1993 |
| WO | WO-94/00569 A1 | 1/1994 |
| WO | WO-94/02602 A1 | 2/1994 |
| WO | WO-94/10308 A1 | 5/1994 |
| WO | WO-94/25585 A1 | 11/1994 |
| WO | WO-95/07463 A1 | 3/1995 |
| WO | WO-96/14436 A1 | 5/1996 |
| WO | WO-96/33735 A1 | 10/1996 |
| WO | WO-96/34096 A1 | 10/1996 |
| WO | WO-97/13852 A1 | 4/1997 |
| WO | WO-97/38731 A1 | 10/1997 |
| WO | WO-98/14605 A1 | 4/1998 |
| WO | WO-98/24884 A1 | 6/1998 |
| WO | WO-98/24893 A2 | 6/1998 |
| WO | WO-98/26277 A2 | 6/1998 |
| WO | WO-98/52976 A1 | 11/1998 |
| WO | WO-99/49019 A2 | 9/1999 |
| WO | WO-99/54440 A1 | 10/1999 |
| WO | WO-00/34317 A2 | 6/2000 |
| WO | WO-00/76310 A1 | 12/2000 |
| WO | WO-03/047336 A2 | 6/2003 |
| WO | WO 2004/003019 * | 6/2004 |
| WO | WO-2005/067391 A2 | 7/2005 |
| WO | WO-2006/138181 A2 | 12/2006 |
| WO | WO-2007/042261 A2 | 4/2007 |
| WO | WO-2008/119567 A2 | 10/2008 |
| WO | WO-2009/055937 A1 | 5/2009 |

OTHER PUBLICATIONS

Chalfie et al., Green fluorescent protein as a marker for gene expression. *Science* 263(5148): 802-5 (1994).

Cheadle et al., Cloning and expression of the variable regions of mouse myeloma protein MOPC315 in *E. coli*: recovery of active Fv fragments. *Mol. Immunol.* 29(1): 21-30 (1992).

Cheson et al., Report of an international workshop to standardize response criteria for non-Hodgkin's lymphomas. NCI Sponsored International Working Group. *J. Clin. Oncol.* 17(4): 1244 (1999).

Chothia et al., Canonical structures for the hypervariable regions of immunoglobulins. *J. Mol. Biol.* 196(4): 901-17 (1987).

Chothia et al., Conformations of immunoglobulin hypervariable regions. *Nature* 342(6252): 877-83 (1989).

Clackson et al., Making antibody fragments using phage display libraries. *Nature* 352(6336): 624-8 (1991).

Cole et al., Monoclonal Antibodies and Cancer Therapy. Alan R. Liss, Inc. 77-96 (1985).

Cook et al., The human immunoglobulin VH repertoire. *Immunol. Today* 16(5): 237-42 (1995).

Cunningham et al., High-resolution epitope mapping of hGH-receptor interactions by alanine-scanning mutagenesis. *Science* 244(4908): 1081-5 (1989).

Dall'Acqua et al., Contribution of domain interface residues to the stability of antibody CH3 domain homodimers. *Biochemistry* 37(26): 9266-73 (1998).

Devereux et al., A comprehensive set of sequence analysis programs for the VAX. *Nucleic Acids Res.* 12(1 Pt 1): 387-95 (1984).

Duskin et al., Relationship of the structure and biological activity of the natural homologues of tunicamycin. *J. Biol. Chem.* 257: 3105-9 (1982).

Edge et al., Deglycosylation of glycoproteins by trifluoromethanesulfonic acid. *Anal. Biochem.* 118(1): 131-7 (1981).

Eppstein et al., Biological activity of liposome-encapsulated murine interferon gamma is mediated by a cell membrane receptor. *Proc. Natl. Acad. Sci. U.S.A.* 82(11): 3688-92 (1985).

Fanslow et al., Structural characteristics of CD40 ligand that determine biological function. *Semin. Immunol.* 6(5): 267-78 (1994).

Fecker et al., Expression of single-chain antibody fragments (scFv) specific for beet necrotic yellow vein virus coat protein or 25 kDa protein in *Escherichia coli* and *Nicotiana benthamiana*. *Plant Mol. Biol.* 32(5): 979-86 (1996).

(56) References Cited

OTHER PUBLICATIONS

Gabizon et al., Pharmacokinetics and tissue distribution of doxorubicin encapsulated in stable liposomes with long circulation times. *J. Natl. Cancer Inst.* 81(19): 1484-8 (1989).
Genbank Accession No. U55762, Cloning vector pEGFP-N1, complete sequence, enhanced green fluorescent protein (egfp) and neomycin phosphotransferase genes, complete cds, dated Aug. 22, 2003.
Graham et al., Characteristics of a human cell line transformed by DNA from human adenovirus type 5. *J. Gen. Virol.* 36(1): 59-74 (1977).
Green et al., Antigen-specific human monoclonal antibodies from mice engineered with human Ig heavy and light chain YACs. *Nat. Genet.* 7(1): 13-21 (1994).
Green et al., Regulation of B cell development by variable gene complexity in mice reconstituted with human immunoglobulin yeast artificial chromosomes. *J. Exp. Med.* 188(3): 483-95 (1998).
Hakimuddin et al., A chemical method for the deglycosylation of proteins. *Arch. Biochem. Biophys.* 259: 52 (1987).
Hawkins et al., Selection of phage antibodies by binding affinity. Mimicking affinity maturation. *J. Mol. Biol.* 226(3): 889-96 (1992).
Heim et al., Engineering green fluorescent protein for improved brightness, longer wavelengths and fluorescence resonance energy transfer. *Curr. Biol.* 6(2): 178-82 (1996).
Hess et al., Vaccination with mRNAs encoding tumor-associated antigens and granulocyte-macrophage colony-stimulating factor efficiently primes CTL responses, but is insufficient to overcome tolerance to a model tumor/self antigen. *Cancer Immunol. Immunother.* 20: 1-12 (2005).
Hiatt et al., Production of antibodies in transgenic plants. *Nature* 342(6245): 76-8 (1989).
Higgins et al., Fast and sensitive multiple sequence alignments on a microcomputer. *Comput. Appl. Biosci.* 5(2): 151-3 (1989).
Hollinger et al., "Diabodies": small bivalent and bispecific antibody fragments. *Proc. Natl. Acad. Sci. USA*, 90(14): 6444-8 (1993).
Hoppe et al., A parallel three stranded alpha-helical bundle at the nucleation site of collagen triple-helix formation. *FEBS Lett.* 344(2-3): 191-5 (1994).
Huston et al., Protein engineering of antibody binding sites: recovery of specific activity in an anti-digoxin single-chain Fv analogue produced in *Escherichia coli*. *Proc. Natl. Acad. Sci. USA* 85(16): 5879-83 (1988).
Hwang et al., Hepatic uptake and degradation of unilamellar sphingomyelin/cholesterol liposomes: a kinetic study. *Proc. Natl Acad. Sci. USA* 77(7): 4030-4 (1980).
Hwang et al., Immunogenicity of engineered antibodies. *Methods*, 36(1): 3-10 (2005).
Ichiki et al., Regulation of the expression of human C epsilon germline transcript. Identification of a novel IL-4 responsive element. *J. Immunol.* 150(12): 5408-17 (1993).
Jones et al., Replacing the complementarity-determining regions in a human antibody with those from a mouse. *Nature* 321(6069): 522-5 (1986).
Karlin et al., Applications and statistics for multiple high-scoring segments in molecular sequences. *Proc. Natl. Acad. Sci. USA* 90(12): 5873-87 (1993).
Kendrick et al., Physical stabilization of proteins in aqueous solution in: Rational Design of Stable Protein Formulations: Theory and Practice. Carpenter et al. (eds.), *Pharm. Biotechnol.* 13: 61-84 (2002).
Kipriyanov et al., Bispecific tandem diabody for tumor therapy with improved antigen binding and pharmacokinetics. *J. Mol. Biol.* 293(1): 41-56 (1999).
Koehler et al., Continuous cultures of fused cells secreting antibody of predefined specificity. *Nature* 256(5517): 495-7 (1975).
Kools et al., Characterization of three novel human cadherin genes (CDH7, CDH19, and CDH20) clustered on chromosome 18q22-q23 and with high homology to chicken cadherin-7. *Genomics* 68(3): 283-95 (2000).
Kozbor et al., The production of monoclonal antibodies from human lymphocytes. *Immunol. Today* 4(3): 72-9 (1983).
Kufer et al., A revival of bispecific antibodies. *Trends Biotechnol.* 22(5): 238-44 (2004).
Kufer et al., Construction and biological activity of a recombinant bispecific single-chain antibody designed for therapy of minimal residual colorectal cancer. *Cancer Immunol. Immunother.* 45(3-4): 193-7 (1997).
Landschulz et al., The leucine zipper: a hypothetical structure common to a new class of DNA binding proteins. *Science* 240(4860): 1759-64 (1988).
Langer et al., Biocompatibility of polymeric delivery systems for macromolecules. *J. Biomed. Mater. Res.* 15(2): 267-77 (1981).
Langer, Controlled release of macromolecules. *Chemtech.* 12: 98-105 (1982).
Löffler et al, A recombinant bispecific single-chain antibody, CD19 x CD3, induces rapid and high lymphoma-directed cytotoxicity by unstimulated T lymphocytes. *Blood* 95(6): 2098-103 (2000).
Lowman et al., Selecting high-affinity binding proteins by monovalent phage display. *Biochemistry*, 30(45): 10832-7 (1991).
MacCallum et al., Antibody-antigen interactions: contact analysis and binding site topography. *J. Mol. Biol.* 262(5): 732-45 (1996).
Mack et al., A small bispecific antibody construct expressed as a functional single-chain molecule with high tumor cell cytotoxicity. *Proc. Natl. Acad. Sci. USA* 92(15): 7021-5 (1995).
Mack et al., Biologic properties of a bispecific single-chain antibody directed against 17-1A (EpCAM) and CD3: tumor cell-dependent T cell stimulation and cytotoxic activity. *J. Immunol.* 158(8): 3965-70 (1997).
Malmborg et al., BIAcore as a tool in antibody engineering. *J. Immunol. Methods* 183(1): 7-13 (1995).
Marks et al., By-passing immunization. Human antibodies from V-gene libraries displayed on phage. *J. Mol. Biol.* 222(3): 581-7 (1991).
Martin et al., Irreversible coupling of immunoglobulin fragments to preformed vesicles. An improved method for liposome targeting. *J. Biol. Chem.* 257(1): 286-8 (1982).
Martin et al., Structural families in loops of homologous proteins: automatic classification, modelling and application to antibodies. *J. Mol. Biol.* 263(5): 800-15 (1996).
Mather et al., Culture of testicular cells in hormone-supplemented serum-free medium. *Ann. N. Y. Acad. Sci.* 383: 44-68 (1982).
Mather, Establishment and characterization of two distinct mouse testicular epithelial cell lines. *Biol. Reprod.* 23(1): 243-51 (1980).
Mendez et al., Functional transplant of megabase human immunoglobulin loci recapitulates human antibody response in mice. *Nat. Genet.* 15(2): 146-56 (1997).
Morrison et al., Chimeric human antibody molecules: mouse antigen-binding domains with human constant region domains. *Proc. Natl. Acad. Sci. USA* 81: 6851-5 (1984).
Morrison et al., Combinatorial alanine-scanning. *Curr. Opin. Chem. Biol.* 5(3): 302-7 (2001).
Morrison, Transfectomas provide novel chimeric antibodies. *Science* 229(4719): 1202-7 (1985).
Needleman et al., A general method applicable to the search for similarities in the amino acid sequence of two proteins. *J. Mol. Biol.* 48(3): 443-53 (1970).
Nolan et al., Fluorescence-activated cell analysis and sorting of viable mammalian cells based on beta-D-galactosidase activity after transduction of *Escherichia coli* lacZ. *Proc. Natl. Acad. Sci. USA* 85(8): 2603-7 (1988).
Olsson et al., Human--human monoclonal antibody-producing hybridomas: technical aspects. *Meth. Enzymol.* 92: 3-16 (1982).
Owen et al., Synthesis of a functional anti-phytochrome single-chain Fv protein in transgenic tobacco. *Biotechnology (NY)* 10(7): 790-4 (1992).
Pearson et al., Improved tools for biological sequence comparison. *Proc. Nat. Acad. Sci. USA* 85(8): 2444-8 (1988).
Presta, Antibody engineering. *Curr. Op. Struct. Biol.* 2: 593-6 (1992).
Raag et al., Single-chain Fvs. *FASEB J.* 9(1): 73-80 (1995).
Randolph et al., Surfactant-protein interactions. *Pharm. Biotechnol.* 13: 159-75 (2002).

(56) References Cited

OTHER PUBLICATIONS

Riechmann et al., Reshaping human antibodies for therapy. *Nature* 332(6162): 323-7 (1988).
Schier et al., Efficient in vitro affinity maturation of phage antibodies using BIAcore guided selections. *Hum. Antibodies Hybridomas* 7(3): 97-105 (1996).
Sidman et al., Controlled release of macromolecules and pharmaceuticals from synthetic polypeptides based on glutamic acid. *Biopolymers* 22(1): 547-56 (1983).
Smith et al., Comparison of biosequences. *Adv. Appl. Math.* 2(4): 482-9 (1981).
Smith, Filamentous fusion phage: novel expression vectors that display cloned antigens on the virion surface. *Science* 228(4705): 1315-17 (1985).
Songsivilai et al., Bispecific antibody: a tool for diagnosis and treatment of disease. *Clin. Exp. Immunol.* 79(3): 315-21 (1990).
Stauber et al., Development and applications of enhanced green fluorescent protein mutants. *Biotechniques* 24(3): 462-71 (1998).
Takahashi et al., Identification of a novel type II classical cadherin: Rat cadherin19 is expressed in the cranial ganglia and Schwann cell precursors during development. *Dev. Dyn.* 232(1): 200-8 (2005).
Takeda et al., Construction of chimaeric processed immunoglobulin genes containing mouse variable and human constant region sequences. *Nature* 314(6010): 452-4 (1985).
Teng et al., Construction and testing of mouse—human heteromyelomas for human monoclonal antibody production. *Proc. Natl. Acad. Sci. USA* 80(23): 7308-12 (1983).
Thotakura et al., Enzymatic deglycosylation of glycoproteins. *Meth. Enzymol.* 138: 350-9 (1987).
Tomlinson et al., The repertoire of human germline VH sequences reveals about fifty groups of VH segments with different hypervariable loops. *J. Mol. Biol.* 227: 776-98 (1992).
Tomlinson et al., The structural repertoire of the human V kappa domain. *EMBO J.* 14(18): 4628-38 (1995).
Urlaub et al., Isolation of Chinese hamster cell mutants deficient in dihydrofolate reductase activity. *Proc. Natl. Acad. Sci. USA* 77(7): 4216-20 (1980).

\* cited by examiner

ANTIBODY CONSTRUCTS FOR CDH19 AND CD3

The present invention relates to a bispecific antibody construct comprising a first human binding domain which binds to human CDH19 on the surface of a target cell and a second binding domain which binds to human CD3 on the surface of a T cell. Moreover, the invention provides a polynucleotide encoding the antibody construct, a vector comprising said polynucleotide and a host cell transformed or transfected with said polynucleotide or vector. Furthermore, the invention provides a process for the production of the antibody construct of the invention, a medical use of said antibody construct and a kit comprising said antibody construct.

Melanoma is a skin cancer that is caused by the oncogenic transformation of melanocytes, which are pigment producing skin cells. As of 2009, Melanoma had a prevalence of more than 870,000 cases in the US alone (US National Institutes of Health). Each year, over 75,000 new cases of melanoma are diagnosed in the US, and approximately 25% of patients have advanced disease at the time of diagnosis. Despite the fact that cases of primary melanoma can be cured by surgery if they are detected early enough, melanoma is the leading cause of death from skin disease in the US, responsible for about 10,000 deaths per year in the US. Once the disease has spread and became metastatic, the prognosis is poor, with a 5 year relative survival of 15%.

There are four basic types of melanomas. Three types are found in the top layers of the skin and the fourth one is invasive and has penetrated deeper into the skin and may have spread to other areas of the body.

Superficial spreading melanoma is the most common type of melanoma which accounts for about 70% of all cases. It grows along the top layer of the skin for a fairly long time before penetrating more deeply. It first appears as a flat or slightly raised discolored patch that has irregular borders and may be somewhat asymmetrical in form. The color varies, and you may see areas of tan, brown, black, red, blue or white. This type of melanoma can occur in a previously benign mole and is found most often in young people.

Lentigo maligna is similar to the superficial spreading type, as it also remains close to the skin surface for quite a while, and usually appears as a flat or mildly elevated mottled tan, brown or dark brown discoloration. It is found most often in the elderly. When this cancer becomes invasive, it is referred to as lentigo maligna melanoma.

Acral lentiginous melanoma also spreads superficially before penetrating more deeply. It is quite different from the others, though, as it usually appears as a black or brown discoloration under the nails or on the soles of the feet or palms of the hands. This type of melanoma is sometimes found on dark-skinned people, and can often advance more quickly than superficial spreading melanoma and lentigo maligna.

Nodular melanoma is usually invasive at the time it is first diagnosed. The malignancy is recognized when it becomes a bump. It is usually black, but occasionally is blue, gray, white, brown, tan, red or skin tone. This is the most aggressive of the melanomas, and is found in 10 to 15 percent of cases.

Common treatments for metastatic melanoma include chemotherapy, targeted therapies for eligible patients (e.g. BRAF inhibitor treatment for patients with BRAF mutations) and immunotherapy. Metastatic melanoma is a tumor type where immunotherapy has been demonstrated to not only slow disease progression, but to lead to cures in late stage patients. Interleukin-2 was approved for the use in metastatic melanoma in 1998, and in 2011 an antibody targeting CTLA4, a member of a new generation of immune checkpoint inhibitors, gained approval by the FDA.

CDH19 is a type II cadherin transmembrane protein of unknown function. The human gene was cloned in 2000 based on its sequence similarity to CDH7 (Kools, P. et al. Genomics. 2000). Expressed Sequence Tags (ESTs) for CDH19 were isolated from melanocyte cDNA libraries, indicating that expression of CDH19 may be limited to cells of neural crest origin (Kools, P. et al. Genomics. 2000). In support of this notion, rat CDH19 was found to be expressed primarily in nerve ganglia and in Schwann cells during rat embryonic development (Takahashi, M. and Osumi, O. Devl Dynamics. 2005).

Diagnostic antibodies detecting CDH19 in Western Blot, immunohistochemitstry or flow cytometry are known in the art and commercially available. Those antibodies comprise poly- and monoclonal antibodies generated in animal hosts.

In an internal analysis of proprietary mRNA expression data it has been surprisingly found that CDH19 expression is elevated in both primary and metastatic melanoma tumors compared to normal, untransformed tissues. Internal analysis also confirmed that expression of CDH19 in normal tissues is limited to neural crest derived peripheral nerve ganglia and nerve fibers. The differential CDH19 expression in normal and tumor tissues makes this protein attractive for cell-surface targeting therapeutics. Although CDH19 was discussed as one marker as part of long lists of markers associated with some cancer types (see e.g. WO 2009/055937) or Parkinson's disease (see e.g. WO 2005/067391) CDH19 was never discussed as a prognostic marker or a drug target in connection with melanoma tumors.

As there is still a need for having available further options for the treatment of melanoma, there are provided herewith means and methods for the solution of this problem in the form of a bispecific antibody construct with one binding domain directed to CDH19 and with a second binding domain directed to CD3 on T cells.

Thus, in a first aspect the present invention provides a bispecific antibody construct comprising a first human binding domain which binds to human CDH19 on the surface of a target cell and a second binding domain which binds to human CD3 on the surface of a T cell, wherein the first binding domain comprises a VH region comprising CDR-H1, CDR-H2 and CDR-H3 and a VL region comprising CDR-L1, CDR-L2 and CDR-L3 selected from the group consisting of:

(a) CDR-H1 as depicted in SEQ ID NO: 14, CDR-H2 as depicted in SEQ ID NO: 15, CDR-H3 as depicted in SEQ ID NO: 16, CDR-L1 as depicted in SEQ ID NO: 17, CDR-L2 as depicted in SEQ ID NO: 18 and CDR-L3 as depicted in SEQ ID NO: 19;

CDR-H1 as depicted in SEQ ID NO: 27, CDR-H2 as depicted in SEQ ID NO: 28, CDR-H3 as depicted in SEQ ID NO: 29, CDR-L1 as depicted in SEQ ID NO: 30, CDR-L2 as depicted in SEQ ID NO: 31 and CDR-L3 as depicted in SEQ ID NO: 32;

CDR-H1 as depicted in SEQ ID NO: 40, CDR-H2 as depicted in SEQ ID NO: 41, CDR-H3 as depicted in SEQ ID NO: 42, CDR-L1 as depicted in SEQ ID NO: 43, CDR-L2 as depicted in SEQ ID NO: 44 and CDR-L3 as depicted in SEQ ID NO: 45;

CDR-H1 as depicted in SEQ ID NO: 53, CDR-H2 as depicted in SEQ ID NO: 54, CDR-H3 as depicted in SEQ ID NO: 55, CDR-L1 as depicted in SEQ ID NO:

56, CDR-L2 as depicted in SEQ ID NO: 57 and CDR-L3 as depicted in SEQ ID NO: 58;

CDR-H1 as depicted in SEQ ID NO: 66, CDR-H2 as depicted in SEQ ID NO: 67, CDR-H3 as depicted in SEQ ID NO: 68, CDR-L1 as depicted in SEQ ID NO: 69, CDR-L2 as depicted in SEQ ID NO: 70 and CDR-L3 as depicted in SEQ ID NO: 71;

CDR-H1 as depicted in SEQ ID NO: 79, CDR-H2 as depicted in SEQ ID NO: 80, CDR-H3 as depicted in SEQ ID NO: 81, CDR-L1 as depicted in SEQ ID NO: 82, CDR-L2 as depicted in SEQ ID NO: 83 and CDR-L3 as depicted in SEQ ID NO: 84;

CDR-H1 as depicted in SEQ ID NO: 92, CDR-H2 as depicted in SEQ ID NO: 93, CDR-H3 as depicted in SEQ ID NO: 94, CDR-L1 as depicted in SEQ ID NO: 95, CDR-L2 as depicted in SEQ ID NO: 96 and CDR-L3 as depicted in SEQ ID NO: 97;

CDR-H1 as depicted in SEQ ID NO: 105, CDR-H2 as depicted in SEQ ID NO: 106, CDR-H3 as depicted in SEQ ID NO: 107, CDR-L1 as depicted in SEQ ID NO: 108, CDR-L2 as depicted in SEQ ID NO: 109 and CDR-L3 as depicted in SEQ ID NO: 110;

CDR-H1 as depicted in SEQ ID NO: 118, CDR-H2 as depicted in SEQ ID NO: 119, CDR-H3 as depicted in SEQ ID NO: 120, CDR-L1 as depicted in SEQ ID NO: 121, CDR-L2 as depicted in SEQ ID NO: 122 and CDR-L3 as depicted in SEQ ID NO: 123;

CDR-H1 as depicted in SEQ ID NO: 131, CDR-H2 as depicted in SEQ ID NO: 132, CDR-H3 as depicted in SEQ ID NO: 133, CDR-L1 as depicted in SEQ ID NO: 134, CDR-L2 as depicted in SEQ ID NO: 135 and CDR-L3 as depicted in SEQ ID NO: 136;

CDR-H1 as depicted in SEQ ID NO: 144, CDR-H2 as depicted in SEQ ID NO: 145, CDR-H3 as depicted in SEQ ID NO: 146, CDR-L1 as depicted in SEQ ID NO: 147, CDR-L2 as depicted in SEQ ID NO: 148 and CDR-L3 as depicted in SEQ ID NO: 149;

CDR-H1 as depicted in SEQ ID NO: 157, CDR-H2 as depicted in SEQ ID NO: 158, CDR-H3 as depicted in SEQ ID NO: 159, CDR-L1 as depicted in SEQ ID NO: 160, CDR-L2 as depicted in SEQ ID NO: 161 and CDR-L3 as depicted in SEQ ID NO: 162, CDR-H1 as depicted in SEQ ID NO: 170, CDR-H2 as depicted in SEQ ID NO: 171, CDR-H3 as depicted in SEQ ID NO: 172, CDR-L1 as depicted in SEQ ID NO: 173, CDR-L2 as depicted in SEQ ID NO: 174 and CDR-L3 as depicted in SEQ ID NO: 175;

CDR-H1 as depicted in SEQ ID NO: 183, CDR-H2 as depicted in SEQ ID NO: 184, CDR-H3 as depicted in SEQ ID NO: 185, CDR-L1 as depicted in SEQ ID NO: 186, CDR-L2 as depicted in SEQ ID NO: 187 and CDR-L3 as depicted in SEQ ID NO: 188;

CDR-H1 as depicted in SEQ ID NO: 196, CDR-H2 as depicted in SEQ ID NO: 197, CDR-H3 as depicted in SEQ ID NO: 198, CDR-L1 as depicted in SEQ ID NO: 199, CDR-L2 as depicted in SEQ ID NO: 200 and CDR-L3 as depicted in SEQ ID NO: 201;

CDR-H1 as depicted in SEQ ID NO: 209, CDR-H2 as depicted in SEQ ID NO: 210, CDR-H3 as depicted in SEQ ID NO: 211, CDR-L1 as depicted in SEQ ID NO: 212, CDR-L2 as depicted in SEQ ID NO: 213 and CDR-L3 as depicted in SEQ ID NO: 214;

CDR-H1 as depicted in SEQ ID NO: 222, CDR-H2 as depicted in SEQ ID NO: 223, CDR-H3 as depicted in SEQ ID NO: 224, CDR-L1 as depicted in SEQ ID NO: 225, CDR-L2 as depicted in SEQ ID NO: 226 and CDR-L3 as depicted in SEQ ID NO: 227;

CDR-H1 as depicted in SEQ ID NO: 235, CDR-H2 as depicted in SEQ ID NO: 236, CDR-H3 as depicted in SEQ ID NO: 237, CDR-L1 as depicted in SEQ ID NO: 238, CDR-L2 as depicted in SEQ ID NO: 239 and CDR-L3 as depicted in SEQ ID NO: 240;

CDR-H1 as depicted in SEQ ID NO: 248, CDR-H2 as depicted in SEQ ID NO: 249, CDR-H3 as depicted in SEQ ID NO: 250, CDR-L1 as depicted in SEQ ID NO: 251, CDR-L2 as depicted in SEQ ID NO: 252 and CDR-L3 as depicted in SEQ ID NO: 253;

CDR-H1 as depicted in SEQ ID NO: 261, CDR-H2 as depicted in SEQ ID NO: 262, CDR-H3 as depicted in SEQ ID NO: 263, CDR-L1 as depicted in SEQ ID NO: 264, CDR-L2 as depicted in SEQ ID NO: 265 and CDR-L3 as depicted in SEQ ID NO: 266;

CDR-H1 as depicted in SEQ ID NO: 274, CDR-H2 as depicted in SEQ ID NO: 275, CDR-H3 as depicted in SEQ ID NO: 276, CDR-L1 as depicted in SEQ ID NO: 277, CDR-L2 as depicted in SEQ ID NO: 278 and CDR-L3 as depicted in SEQ ID NO: 279;

CDR-H1 as depicted in SEQ ID NO: 287, CDR-H2 as depicted in SEQ ID NO: 288, CDR-H3 as depicted in SEQ ID NO: 289, CDR-L1 as depicted in SEQ ID NO: 290, CDR-L2 as depicted in SEQ ID NO: 291 and CDR-L3 as depicted in SEQ ID NO: 292;

CDR-H1 as depicted in SEQ ID NO: 300, CDR-H2 as depicted in SEQ ID NO: 301, CDR-H3 as depicted in SEQ ID NO: 302, CDR-L1 as depicted in SEQ ID NO: 303, CDR-L2 as depicted in SEQ ID NO: 304 and CDR-L3 as depicted in SEQ ID NO: 305;

CDR-H1 as depicted in SEQ ID NO: 313, CDR-H2 as depicted in SEQ ID NO: 314, CDR-H3 as depicted in SEQ ID NO: 315, CDR-L1 as depicted in SEQ ID NO: 316, CDR-L2 as depicted in SEQ ID NO: 317 and CDR-L3 as depicted in SEQ ID NO: 318;

CDR-H1 as depicted in SEQ ID NO: 508, CDR-H2 as depicted in SEQ ID NO: 509, CDR-H3 as depicted in SEQ ID NO: 510, CDR-L1 as depicted in SEQ ID NO: 511, CDR-L2 as depicted in SEQ ID NO: 512 and CDR-L3 as depicted in SEQ ID NO: 513;

CDR-H1 as depicted in SEQ ID NO: 521, CDR-H2 as depicted in SEQ ID NO: 522, CDR-H3 as depicted in SEQ ID NO: 523, CDR-L1 as depicted in SEQ ID NO: 524, CDR-L2 as depicted in SEQ ID NO: 525 and CDR-L3 as depicted in SEQ ID NO: 526;

CDR-H1 as depicted in SEQ ID NO: 534, CDR-H2 as depicted in SEQ ID NO: 535, CDR-H3 as depicted in SEQ ID NO: 536, CDR-L1 as depicted in SEQ ID NO: 537, CDR-L2 as depicted in SEQ ID NO: 538 and CDR-L3 as depicted in SEQ ID NO: 539;

CDR-H1 as depicted in SEQ ID NO: 547, CDR-H2 as depicted in SEQ ID NO: 548, CDR-H3 as depicted in SEQ ID NO: 549, CDR-L1 as depicted in SEQ ID NO: 550, CDR-L2 as depicted in SEQ ID NO: 551 and CDR-L3 as depicted in SEQ ID NO: 552;

CDR-H1 as depicted in SEQ ID NO: 560, CDR-H2 as depicted in SEQ ID NO: 561, CDR-H3 as depicted in SEQ ID NO: 562, CDR-L1 as depicted in SEQ ID NO: 563, CDR-L2 as depicted in SEQ ID NO: 564 and CDR-L3 as depicted in SEQ ID NO: 565;

CDR-H1 as depicted in SEQ ID NO: 573, CDR-H2 as depicted in SEQ ID NO: 574, CDR-H3 as depicted in SEQ ID NO: 575, CDR-L1 as depicted in SEQ ID NO: 576, CDR-L2 as depicted in SEQ ID NO: 577 and CDR-L3 as depicted in SEQ ID NO: 578; and CDR-H1 as depicted in SEQ ID NO: 586 CDR-H2 as depicted in SEQ ID NO: 587, CDR-H3 as depicted in SEQ ID NO: 588, CDR-L1 as depicted in SEQ ID NO: 589, CDR-L2 as depicted in SEQ ID NO: 590 and CDR-L3 as depicted in SEQ ID NO: 591; and (b) CDR-H1 as depicted in SEQ ID NO: 1, CDR-H2 as depicted in SEQ ID NO: 2, CDR-H3 as depicted in SEQ ID NO: 3, CDR-L1 as depicted in SEQ ID NO: 4, CDR-L2 as depicted in SEQ ID NO: 5 and CDR-L3 as depicted in SEQ ID NO: 6;

CDR-H1 as depicted in SEQ ID NO: 326, CDR-H2 as depicted in SEQ ID NO: 327, CDR-H3 as depicted in SEQ ID NO: 328, CDR-L1 as depicted in SEQ ID NO: 329, CDR-L2 as depicted in SEQ ID NO: 330 and CDR-L3 as depicted in SEQ ID NO: 331;

CDR-H1 as depicted in SEQ ID NO: 339, CDR-H2 as depicted in SEQ ID NO: 340, CDR-H3 as depicted in SEQ ID NO: 341, CDR-L1 as depicted in SEQ ID NO: 342, CDR-L2 as depicted in SEQ ID NO: 343 and CDR-L3 as depicted in SEQ ID NO: 344, CDR-H1 as depicted in SEQ ID NO: 352, CDR-H2 as depicted in SEQ ID NO: 353, CDR-H3 as depicted in SEQ ID NO: 354, CDR-L1 as depicted in SEQ ID NO: 355, CDR-L2 as depicted in SEQ ID NO: 356 and CDR-L3 as depicted in SEQ ID NO: 357;

CDR-H1 as depicted in SEQ ID NO: 365, CDR-H2 as depicted in SEQ ID NO: 366, CDR-H3 as depicted in SEQ ID NO: 367, CDR-L1 as depicted in SEQ ID NO: 368, CDR-L2 as depicted in SEQ ID NO: 369 and CDR-L3 as depicted in SEQ ID NO: 370;

CDR-H1 as depicted in SEQ ID NO: 378, CDR-H2 as depicted in SEQ ID NO: 379, CDR-H3 as depicted in SEQ ID NO: 380, CDR-L1 as depicted in SEQ ID NO: 381, CDR-L2 as depicted in SEQ ID NO: 382 and CDR-L3 as depicted in SEQ ID NO: 383;

CDR-H1 as depicted in SEQ ID NO: 391, CDR-H2 as depicted in SEQ ID NO: 392, CDR-H3 as depicted in SEQ ID NO: 393, CDR-L1 as depicted in SEQ ID NO: 394, CDR-L2 as depicted in SEQ ID NO: 395 and CDR-L3 as depicted in SEQ ID NO: 396;

CDR-H1 as depicted in SEQ ID NO: 404, CDR-H2 as depicted in SEQ ID NO: 405, CDR-H3 as depicted in SEQ ID NO: 406, CDR-L1 as depicted in SEQ ID NO: 407, CDR-L2 as depicted in SEQ ID NO: 408 and CDR-L3 as depicted in SEQ ID NO: 409;

CDR-H1 as depicted in SEQ ID NO: 417, CDR-H2 as depicted in SEQ ID NO: 418, CDR-H3 as depicted in SEQ ID NO: 419, CDR-L1 as depicted in SEQ ID NO: 420, CDR-L2 as depicted in SEQ ID NO: 421 and CDR-L3 as depicted in SEQ ID NO: 422;

CDR-H1 as depicted in SEQ ID NO: 430, CDR-H2 as depicted in SEQ ID NO: 431, CDR-H3 as depicted in SEQ ID NO: 432, CDR-L1 as depicted in SEQ ID NO: 433, CDR-L2 as depicted in SEQ ID NO: 434 and CDR-L3 as depicted in SEQ ID NO: 435;

CDR-H1 as depicted in SEQ ID NO: 443, CDR-H2 as depicted in SEQ ID NO: 444, CDR-H3 as depicted in SEQ ID NO: 445, CDR-L1 as depicted in SEQ ID NO: 446, CDR-L2 as depicted in SEQ ID NO: 447 and CDR-L3 as depicted in SEQ ID NO: 448;

CDR-H1 as depicted in SEQ ID NO: 456, CDR-H2 as depicted in SEQ ID NO: 457, CDR-H3 as depicted in SEQ ID NO: 458, CDR-L1 as depicted in SEQ ID NO: 459, CDR-L2 as depicted in SEQ ID NO: 460 and CDR-L3 as depicted in SEQ ID NO: 461, CDR-H1 as depicted in SEQ ID NO: 482, CDR-H2 as depicted in SEQ ID NO: 483, CDR-H3 as depicted in SEQ ID NO: 484, CDR-L1 as depicted in SEQ ID NO: 485, CDR-L2 as depicted in SEQ ID NO: 486 and CDR-L3 as depicted in SEQ ID NO: 487;

CDR-H1 as depicted in SEQ ID NO: 495, CDR-H2 as depicted in SEQ ID NO: 496, CDR-H3 as depicted in SEQ ID NO: 497, CDR-L1 as depicted in SEQ ID NO: 498, CDR-L2 as depicted in SEQ ID NO: 499 and CDR-L3 as depicted in SEQ ID NO: 500; and CDR-H1 as depicted in SEQ ID NO: 599, CDR-H2 as depicted in SEQ ID NO: 600, CDR-H3 as depicted in SEQ ID NO: 601, CDR-L1 as depicted in SEQ ID NO: 602, CDR-L2 as depicted in SEQ ID NO: 603 and CDR-L3 as depicted in SEQ ID NO: 604.

As described in appended example 3, a broad number of CDH19 specific binding domains has been characterized with respect to their binding specificities, and those binding domains were classified into two different groups, each group specifically recognizing one CDH19 epitope cluster. The epitope clusters that were defined—in the context of the present invention—in the extracellular domain of human CDH19 are depicted in FIG. 5. The first group of binding domains was identified to bind to human CDH19 epitope cluster 1 and encompasses the binding domains comprising the CDR sequences depicted under item (a) above. This first group of binding domains preferably does not bind to any additional epitope or epitope cluster (except for epitope cluster 1) within the CDH19 amino acid sequence. The second group of binding domains was identified to bind to human CDH19 epitope cluster 3 and encompasses the binding domains comprising the CDR sequences depicted under item (b) above. This second group of binding domains preferably does not bind to any additional epitope or epitope cluster (except for epitope cluster 3) within the CDH19 amino acid sequence. Epitope clusters 1 and 3 of human CDH19 correspond to amino acid residues as 44-141 in SEQ ID NO: 1836 (epitope cluster 1) and 250-364 SEQ ID NO: 1836 (epitope cluster 3).

It must be noted that as used herein, the singular forms "a", "an", and "the" include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

The term "antibody construct" refers to a molecule in which the structure and/or function is/are based on the structure and/or function of an antibody, e.g. of a full-length or whole immunoglobulin molecule. An antibody construct is hence capable of binding to its specific target or antigen. Furthermore, an antibody construct according to the invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region). The antibodies on which the constructs according to the invention are based include for example monoclonal, recombinant, chimeric, deimmunized, humanized and human antibodies.

Within the definition of "antibody constructs" according to the invention are full-length or whole antibodies including camelid antibodies and other immunoglobulin antibodies generated by biotechnological or protein engineering methods or processes. These full-length antibodies may be for example monoclonal, recombinant, chimeric, deimmunized, humanized and human antibodies. Also within the definition of "antibody constructs" are fragments of full-length antibodies, such as VH, VHH, VL, (s)dAb, Fv, Fd, Fab, Fab', F(ab')2 or "r IgG" ("half antibody"). Antibody constructs according to the invention may also be modified fragments of antibodies, also called antibody variants, such as scFv, di-scFv or bi(s)-scFv, scFv-Fc, scFv-zipper, scFab, Fab2, Fab3, diabodies, single chain diabodies, tandem diabodies (Tandab's), tandem di-scFv, tandem tri-scFv, "minibodies" exemplified by a structure which is as follows: (VH-VL-CH3)2, (scFv-CH3)2 or (scFv-CH3-scFv)2, multibodies such as triabodies or tetrabodies, and single domain antibodies such as nanobodies or single variable domain antibodies comprising merely one variable domain, which might be VHH, VH or VL, that specifically bind an antigen or epitope independently of other V regions or domains.

Furthermore, the definition of the term "antibody constructs" includes monovalent, bivalent and polyvalent/multivalent constructs and, thus, monospecific constructs, specifically binding to only one antigenic structure, as well as bispecific and polyspecific/multispecific constructs, which specifically bind more than one antigenic structure, e.g. two, three or more, through distinct binding domains. Moreover, the definition of the term "antibody constructs" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The antibody constructs of the present invention are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal. A "recombinant antibody" is an antibody made through the use of recombinant DNA technology or genetic engineering.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance (BIACORE™) analysis, to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the BIAcore system can be used to increase the efficiency of phage antibodies which bind to an epitope of a target antigen, such as CDH19 or CD3 epsilon (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetical diversity can be increased by chain shuffling. Two or three rounds of mutation and selection using display methods like phage display usually results in antibody fragments with affinities in the low nanomolar range.

A preferred type of an amino acid substitutional varianation of the antibody constructs involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e. g. 6-7 sites) are mutated to generate all possible amino acid substitutions at each site. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human CDH19. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct or antibody fragment may also be modified by specific deletion of human T cell epitopes (a method called "deimmunization") by the methods disclosed in WO 98/52976 and WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400.

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or site-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse.

In some embodiments, the antibody constructs of the invention are "isolated" or "substantially pure" antibody constructs. "Isolated" or "substantially pure" when used to describe the antibody construct disclosed herein means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes in connection with the present invention a domain which (specifically) binds to/interacts with/recognizes a given target epitope or a given target site on the target molecules (antigens) CDH19 and CD3, respectively. The structure and function of the first binding domain (recognizing CDH19), and preferably also the structure and/or function of the second binding domain (CD3), is/are based on the structure and/or function of an antibody, e.g. of a full-length or whole immunoglobulin molecule. According to the invention, the first binding domain is characterized by the presence of three light chain CDRs (i.e. CDR1, CDR2 and CDR3 of the VL region) and three heavy chain CDRs (i.e. CDR1, CDR2 and CDR3 of the VH region). The second binding domain preferably also comprises the minimum structural requirements of an antibody which allow for the target binding. More preferably, the second binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that the first and/or second binding domain is produced by or obtainable by phage-display or library screening methods rather than by grafting CDR sequences from a pre-existing (monoclonal) antibody into a scaffold.

According to the present invention, binding domains are preferably in the form of polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids). The term "polypeptide" as used herein describes a group of molecules, which usually consist of more than 30 amino acids.

Polypeptides may further form multimers such as dimers, trimers and higher oligomers, i.e. consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

As mentioned above, a binding domain may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Examples of (modified) antigen-binding antibody fragments include (1) a Fab fragment, a monovalent fragment having the VL, VH, CL and CH1 domains; (2) a F(ab')2 fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFV-library).

Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first Xeno-Mouse mouse strains (see Green et al. Nature Genetics 7:13-21 (1994)). The XenoMouse strains were engineered with yeast artificial chromosomes (YACs) containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouse mice is further discussed and delineated in U.S. patent applications Ser. Nos. 07/466,008, 07/610,515, 07/919,297, 07/922,649, 08/031, 801, 08/112,848, 08/234,145, 08/376,279, 08/430,938, 08/464,584, 08/464,582, 08/463,191, 08/462,837, 08/486, 853, 08/486,857, 08/486,859, 08/462,513, 08/724,752, and 08/759,620; and U.S. Pat. Nos. 6,162,963, 6,150,584, 6,114, 598, 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463

151 B1, WO 94/02602, WO 96/34096, WO 98/24893, WO 00/76310, and WO 03/47336.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545,807 to Surani et al. and U.S. Pat. Nos. 5,545,806, 5,625,825, 5,625,126, 5,633,425, 5,661,016, 5,770,429, 5,789,650, 5,814,318, 5,877,397, 5,874,299, and 6,255,458 each to Lonberg and Kay, U.S. Pat. Nos. 5,591,669 and 6,023.010 to Krimpenfort and Berns, U.S. Pat. Nos. 5,612,205, 5,721,367, and 5,789,215 to Berns et al., and U.S. Pat. No. 5,643,763 to Choi and Dunn, and GenPharm International U.S. patent application Ser. Nos. 07/574,748, 07/575,962, 07/810,279, 07/853,408, 07/904,068, 07/990,860, 08/053,131, 08/096,762, 08/155,301, 08/161,739, 08/165,699, 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a fully human binding domain against CDH19 and a fully human binding domain against CD3 in order to vitiate concerns and/or effects of HAMA or HACA response.

The terms "(specifically) binds to", (specifically) recognizes", "is (specifically) directed to", and "(specifically) reacts with" mean in accordance with this invention that a binding domain interacts or specifically interacts with one or more, preferably at least two, more preferably at least three and most preferably at least four amino acids of an epitope located on the target protein or antigen (CDH19/CD3).

The term "epitope" refers to a site on an antigen to which a binding domain, such as an antibody or immunoglobulin or derivative or fragment of an antibody or of an immunoglobulin, specifically binds. An "epitope" is antigenic and thus the term epitope is sometimes also referred to herein as "antigenic structure" or "antigenic determinant". Thus, the binding domain is an "antigen interaction site". Said binding/interaction is also understood to define a "specific recognition".

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigen for one of the binding domains is comprised within the CDH19 protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

The provided examples describe a further method to characterize a given binding domain, which includes a test whether the given binding domain binds to one or more epitope cluster(s) of a given protein, in particular CDH19.

As used herein, the term "epitope cluster" denotes the entirety of epitopes lying in a defined contiguous stretch of an antigen. An epitope cluster can comprise one, two or more epitopes. The concept of "epitope clusters" is also used in the characterization of the features of the antibody constructs of the invention. The epitope clusters that were defined—in the context of the present invention—in the extracellular domain of CDH19 are described above and depicted in FIG. 5.

When an epitope cluster in the human CDH19 protein is exchanged with the respective epitope cluster of a chicken CDH19 antigen (resulting in a construct comprising human CDH19, wherein one human epitope cluster is replaced with its counterpart chicken epitope cluster), a decrease in the binding of the binding domain will occur. Said decrease is preferably at least 10%, 20%, 30%, 40%, 50%; more preferably at least 60%, 70%, 80%, 90%, 95% or even 100% in comparison to the respective epitope cluster in the human CDH19 protein, whereby binding to the respective epitope cluster in the human CDH19 protein is set to be 100%. It is envisaged that the aforementioned human CDH19/chicken CDH19 chimeras are expressed in CHO cells. It is also envisaged that the human CDH19/chicken CDH19 chimeras are fused with a transmembrane domain and/or cytoplasmic domain of a different membrane-bound protein such as EpCAM.

A method to test this loss of binding due to exchange with the respective epitope cluster of a non-human (e.g. chicken, but others like mouse, rat, hamster, rabbit etc. might also be conceivable) CDH19 antigen is described in Examples 3. A further method to determine the contribution of a specific residue of a target antigen to the recognition by a antibody construct or binding domain is alanine scanning (see e.g.

Morrison K L & Weiss GA. Cur Opin Chem Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. Alanine scanning is a mature technology which has been used for a long period of time.

The interaction between the binding domain and the epitope or epitope cluster implies that a binding domain exhibits appreciable affinity for the epitope or epitope cluster on a particular protein or antigen (here: CDH19 and CD3, respectively) and, generally, does not exhibit significant reactivity with proteins or antigens other than CDH19 or CD3. "Appreciable affinity" includes binding with an affinity of about 10-6 M (KD) or stronger. Preferably, binding is considered specific when the binding affinity is about 10-12 to 10-8 M, 10-12 to 10-9 M, 10-12 to 10-10 M, 10-11 to 10-8 M, preferably of about 10-11 to 10-9 M. Whether a binding domain specifically reacts with or binds to a target can be tested readily by, inter alia, comparing the reaction of said binding domain with a target protein or antigen with the reaction of said binding domain with proteins or antigens other than CDH19 or CD3. Preferably, a binding domain of the invention does not essentially or substantially bind to proteins or antigens other than CDH19 or CD3 (i.e., the first binding domain is not capable of binding to proteins other than CDH19 and the second binding domain is not capable of binding to proteins other than CD3).

The term "does not essentially/substantially bind" or "is not capable of binding" means that a binding domain of the present invention does not bind a protein or antigen other than CDH19 or CD3, i.e., does not show reactivity of more than 30%, preferably not more than 20%, more preferably not more than 10%, particularly preferably not more than 9%, 8%, 7%, 6% or 5% with proteins or antigens other than CDH19 or CD3, whereby binding to CDH19 or CD3, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms a single antigen-binding site. The CH domain most proximal to VH is designated as CH1. Each light (L) chain is linked to a heavy (H) chain by one covalent disulfide bond, while the two H chains are linked to each other by one or more disulfide bonds depending on the H chain isotype.

Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM) and provide a scaffold for the six CDRs in three dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding site (see Kabat et al., loc. cit.). The constant domains are not directly involved in antigen binding, but exhibit various effector functions, such as, for example, antibody-dependent, cell-mediated cytotoxicity and complement activation.

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity.

The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. MoI. Biol, 1987, 196: 901-917; and MacCallum et al., J. MoI. Biol, 1996, 262: 732). Still another standard for characterizing the antigen binding site is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. MoI. Biol., 1987, 196: 901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is typically the greatest source of molecular diversity within the antibody-binding site. H3, for example, can be as short as two amino acid residues or greater than 26 amino acids.

The sequence of antibody genes after assembly and somatic mutation is highly varied, and these varied genes are estimated to encode 1010 different antibody molecules (Immunoglobulin Genes, 2nd ed., eds. Jonio et al., Academic Press, San Diego, Calif., 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

In one embodiment, the first binding domain of the antibody construct of the invention comprises a VH region selected from the group consisting of VH regions
(a) as depicted in SEQ ID NO: 21, SEQ ID NO: 34, SEQ ID NO: 47, SEQ ID NO: 60, SEQ ID NO: 73, SEQ ID NO: 86, SEQ ID NO: 99, SEQ ID NO: 112, SEQ ID NO: 125, SEQ ID NO: 138, SEQ ID NO: 151, SEQ ID NO: 164, SEQ ID NO: 177, SEQ ID NO: 190, SEQ ID NO: 203, SEQ ID NO: 216, SEQ ID NO: 229, SEQ ID NO: 242, SEQ ID NO: 255, SEQ ID NO: 268, SEQ ID NO: 281, SEQ ID NO: 294, SEQ ID NO: 307, SEQ ID NO: 320, SEQ ID NO: 515, SEQ ID NO: 528, SEQ ID NO: 541, SEQ ID NO: 554, SEQ ID NO: 567, SEQ ID NO: 580 and SEQ ID NO: 593; and
(b) as depicted in SEQ ID NO: 8, SEQ ID NO: 333, SEQ ID NO: 346, SEQ ID NO: 359, SEQ ID NO: 372, SEQ ID NO: 385, SEQ ID NO: 398, SEQ ID NO: 411, SEQ ID NO: 424, SEQ ID NO: 437, SEQ ID NO: 450, SEQ ID NO: 463, SEQ ID NO: 476, SEQ ID NO: 489, SEQ ID NO: 502 and SEQ ID NO: 606.

In a further embodiment of the antibody construct of the invention, the first binding domain comprises a VL region selected from the group consisting of VL regions
(a) as depicted in SEQ ID NO: 23, SEQ ID NO: 36, SEQ ID NO: 49, SEQ ID NO: 62, SEQ ID NO: 75, SEQ ID NO: 88, SEQ ID NO: 101, SEQ ID NO: 114, SEQ ID NO: 127, SEQ ID NO: 140, SEQ ID NO: 153, SEQ ID NO: 166, SEQ ID NO: 179, SEQ ID NO: 192, SEQ ID NO: 205, SEQ ID NO: 218, SEQ ID NO: 231, SEQ ID NO: 244, SEQ ID NO: 257, SEQ ID NO: 270, SEQ ID NO: 283, SEQ ID NO: 296, SEQ ID NO: 309, SEQ ID NO: 322, SEQ ID NO: 517, SEQ ID NO: 530, SEQ ID NO: 543, SEQ ID NO: 556, SEQ ID NO: 569, SEQ ID NO: 582 and SEQ ID NO: 595; and
(b) as depicted in SEQ ID NO: 10, SEQ ID NO: 335, SEQ ID NO: 348, SEQ ID NO: 361, SEQ ID NO: 374, SEQ ID NO: 387, SEQ ID NO: 400, SEQ ID NO: 413, SEQ ID NO: 426, SEQ ID NO: 439, SEQ ID NO: 452, SEQ ID NO: 465, SEQ ID NO: 478, SEQ ID NO: 491, SEQ ID NO: 504 and SEQ ID NO: 608.

The above specified first binding domains (specified by their VH regions and VL regions, respectively) classified into group (a) all characterize as binding domains specifically recognizing CDH19 epitope cluster 1, while the above specified first binding domains (specified by their VH regions and VL regions, respectively) classified into group (b) all characterize as binding domains specifically recognizing CDH19 epitope cluster 3.

In another embodiment of the antibody construct of the invention, the first binding domain comprises a VH region and a VL region selected from the group consisting of:
(a) pairs of a VH region and a VL region as depicted in SEQ ID NO: 21+23, SEQ ID NO: 34+36, SEQ ID NO: 47+49, SEQ ID NO: 60+62, SEQ ID NO: 73+75, SEQ ID NO: 86+88, SEQ ID NO: 99+101, SEQ ID NO: 112+114, SEQ ID NO: 125+127, SEQ ID NO: 138+140, SEQ ID NO: 151+153, SEQ ID NO: 164+166, SEQ ID NO: 177+179, SEQ ID NO: 190+192, SEQ ID NO: 203+205, SEQ ID NO: 216+218, SEQ ID NO: 229+231, SEQ ID NO: 242+244, SEQ ID NO: 255+257, SEQ ID NO: 268+270, SEQ ID NO: 281+283, SEQ ID NO: 294+296, SEQ ID NO: 307+309, SEQ ID NO: 320+322, SEQ ID NO: 515+517, SEQ ID NO: 528+530, SEQ ID NO: 541+543, SEQ ID NO: 554+556, SEQ ID NO: 567+569, SEQ ID NO: 580+582 and SEQ ID NO: 593+595; and (b) pairs of a VH region and a VL region as depicted in SEQ ID NO: 8+10, SEQ ID NO: 333+335, SEQ ID NO: 346+348, SEQ ID NO: 359+361, SEQ ID NO: 372+374, SEQ ID NO: 385+387, SEQ ID NO: 398+400, SEQ ID NO: 411+413, SEQ ID NO: 424+426, SEQ ID NO: 437+439, SEQ ID NO: 450+452, SEQ ID NO: 463+465, SEQ ID NO: 476+478, SEQ ID NO: 489+491, SEQ ID NO: 502+504 and SEQ ID NO: 606+608.

The above specified first binding domains (comprising pairs of a VH region and a VL region) belonging to item or group (a) all characterize as binding domains specifically recognizing CDH19 epitope cluster 1, while the above specified first binding domains (comprising pairs of a VH region and a VL region) belonging to item or group (b) all characterize as binding domains specifically recognizing CDH19 epitope cluster 3.

The term "bispecific" as used herein refers to an antibody construct which is "at least bispecific", i.e., it comprises at least a first binding domain and a second binding domain, wherein the first binding domain binds to one antigen or target (here: CDH19), and the second binding domain binds to another antigen or target (here: CD3). Accordingly, antibody constructs according to the invention comprise specificities for at least two different antigens or targets. The term "bispecific antibody construct" of the invention also encompasses multispecific antibody constructs such as trispecific antibody constructs, the latter ones including three binding domains, or constructs having more than three (e.g. four, five . . . ) specificities.

Given that the antibody constructs according to the invention are (at least) bispecific, they do not occur naturally and they are markedly different from naturally occurring products. A "bispecific" antibody construct or immunoglobulin is hence an artificial hybrid antibody or immunoglobulin having at least two distinct binding sites with different specificities. Bispecific antibodies can be produced by a variety of methods including fusion of hybridomas or linking of Fab' fragments. See, e.g., Songsivilai & Lachmann, Clin. Exp. Immunol. 79:315-321 (1990).

The at least two binding domains and the variable domains of the antibody construct of the present invention may or may not comprise peptide linkers (spacer peptides). The term "peptide linker" defines in accordance with the present invention an amino acid sequence by which the amino acid sequences of one (variable and/or binding) domain and another (variable and/or binding) domain of the antibody construct of the invention are linked with each other. An essential technical feature of such peptide linker is that said peptide linker does not comprise any polymerization activity. Among the suitable peptide linkers are those described in U.S. Pat. Nos. 4,751,180 and 4,935,233 or WO 88/09344.

In the event that a linker is used, this linker is preferably of a length and sequence sufficient to ensure that each of the first and second domains can, independently from one another, retain their differential binding specificities. For peptide linkers which connect the at least two binding domains in the antibody construct of the invention (or two variable domains), those peptide linkers are preferred which comprise only a few number of amino acid residues, e.g. 12 amino acid residues or less. Thus, peptide linker of 12, 11, 10, 9, 8, 7, 6 or 5 amino acid residues are preferred. An envisaged peptide linker with less than 5 amino acids comprises 4, 3, 2 or one amino acid(s) wherein Gly-rich linkers are preferred. A particularly preferred "single" amino acid in context of said "peptide linker" is Gly. Accordingly, said peptide linker may consist of the single amino acid Gly.

Another preferred embodiment of a peptide linker is characterized by the amino acid sequence Gly-Gly-Gly-Gly-Ser, i.e. Gly4Ser, or polymers thereof, i.e. (Gly4Ser)x, where x is an integer of 1 or greater. The characteristics of said peptide linker, which comprise the absence of the promotion of secondary structures are known in the art and are described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which also do not promote any secondary structures are preferred. The linkage of said domains to each other can be provided by, e.g. genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, N.Y., 2001).

The invention hence provides a preferred embodiment wherein the antibody construct is in a format selected from the group consisting of (scFv)2, scFv-single domain mAb, diabodies and oligomers of any of the afermentioned formats.

According to a particularly preferred embodiment, and as documented in the appended examples, the antibody construct of the invention is a "bispecific single chain antibody construct", more preferably a bispecific "single chain Fv" (scFv). Although the two domains of the Fv fragment, VL and VH, are coded for by separate genes, they can be joined, using recombinant methods, by a synthetic linker that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are whole or full-length antibodies. A single-chain variable fragment (scFv) is hence a fusion protein of the variable region of the heavy chain (VH) and of the light chain (VL) of immunoglobulins, usually connected with a short linker peptide of about ten to about 25 amino acids, preferably about 15 to 20 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and introduction of the linker.

Bispecific single chain molecules are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946, 778, Kontermann and Dübel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format (scFv)2) can be engineered by linking two scFv molecules. If these two scFv molecules have the same binding specificity, the resulting (scFv)2 molecule will preferably be called bivalent (i.e. it has two valences for the same target epitope). If the two scFv molecules have different binding specificities, the resulting (scFv)2 molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8.).

Single domain antibodies comprise merely one (monomeric) antibody variable domain which is able to bind selectively to a specific antigen, independently of other V regions or domains. The first single domain antibodies were engineered from heavy chain antibodies found in camelids, and these are called VHH fragments. Cartilaginous fishes also have heavy chain antibodies (IgNAR) from which single domain antibodies called VNAR fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain mAb)2 is hence a monoclonal antibody construct composed of (at least) two single domain monoclonal antibodies, which are individually selected from the group comprising VH, VL, VHH and VNAR. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

In one embodiment, the first binding domain comprises an amino acid sequence selected from the group consisting of those sequences as depicted in:
(a) SEQ ID NO: 25, SEQ ID NO: 38, SEQ ID NO: 51, SEQ ID NO: 64, SEQ ID NO: 77, SEQ ID NO: 90, SEQ ID NO: 103, SEQ ID NO: 116, SEQ ID NO: 129, SEQ ID NO: 142, SEQ ID NO: 155, SEQ ID NO: 168, SEQ ID NO: 181, SEQ ID NO: 194, SEQ ID NO: 207, SEQ ID NO: 220, SEQ ID NO: 233, SEQ ID NO: 246, SEQ ID NO: 259, SEQ ID NO: 272, SEQ ID NO: 285, SEQ ID NO: 298, SEQ ID NO: 311, SEQ ID NO: 324, SEQ ID NO: 519, SEQ ID NO: 532, SEQ ID NO: 545, SEQ ID NO: 558, SEQ ID NO: 571, SEQ ID NO: 584 and SEQ ID NO: 597; and
(b) SEQ ID NO: 12, SEQ ID NO: 337, SEQ ID NO: 350, SEQ ID NO: 363, SEQ ID NO: 376, SEQ ID NO: 389, SEQ ID NO: 402, SEQ ID NO: 415, SEQ ID NO: 428, SEQ ID NO: 441, SEQ ID NO: 454, SEQ ID NO: 467, SEQ ID NO: 480, SEQ ID NO: 493, SEQ ID NO: 506 and SEQ ID NO: 610.

The above specified first binding domains belonging to item or group (a) all characterize as binding domains specifically recognizing CDH19 epitope cluster 1, while the above specified first binding domains belonging to item or group (b) all characterize as binding domains specifically recognizing CDH19 epitope cluster 3.

It is also envisaged that the antibody construct of the invention has, in addition to its function to bind to the target molecules CDH19 and CD3, a further function. In this format, the antibody construct is a trifunctional or multifunctional antibody construct by targeting target cells through binding to CDH19, mediating cytotoxic T cell activity through CD3 binding and providing a further function such as a fully functional Fc constant domain mediating antibody-dependent cellular cytotoxicity through recruitment of effector cells like NK cells, a label (fluorescent etc.), a therapeutic agent such as a toxin or radionuclide, and/or means to enhance serum half-life, etc.

Examples for means to extend serum half-life of the antibody constructs of the invention include peptides protein domains of proteins, which are fused or otherwise attached to the antibody constructs. The groupe of peptides includes peptides binding to other preoteins with preferred pharmacokinetic profile in the human body such as serum albunin (see the AB156 peptide used in some constructs of the invention) or the constant region of immunoglobulins (Fc domains). An alternatively used concept of such half-life extending peptides includes peptides binding to the neonatal Fc receptor (FcRn), which are also used in some of the constructs of the invention. The concept of attaching larger domains of proteins or complete proteins includes e.g. the fusion of human serum albumin, variants of human serum albumin (see WO 2014/072481) or domains thereof as well as the fusion of constant region of immunoglobulins (Fc domains) and variants thereof. Such variants of Fc domains may be optimized/modified in order to allow the desired pairing of dimers or mulimers, to abolish Fc receptor binding (e.g. th Fc☐ receptor) or for other reasons. A further concept known in the art to extend the half-life of small protein compounds in the human body is the pegylation of those compounds such as the antibody construct of the invention.

Covalent modifications of the antibody constructs are also included within the scope of this invention, and are generally, but not always, done post-translationally. For example, several types of covalent modifications of the antibody construct are introduced into the molecule by reacting specific amino acid residues of the antibody construct with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using 125I or 131I to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for cross-linking the antibody constructs of the present invention to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antibody constructs included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody construct is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence of an antibody construct is preferably altered through changes at the DNA level, particularly by mutating the DNA encoding the polypeptide at preselected bases such that codons are generated that will translate into the desired amino acids.

Another means of increasing the number of carbohydrate moieties on the antibody construct is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330, and in Aplin and Wriston, 1981, CRC Crit. Rev. Biochem., pp. 259-306.

Removal of carbohydrate moieties present on the starting antibody construct may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131. Enzymatic cleavage of carbohydrate moieties on polypeptides can be achieved by the use of a variety of endo- and exo-glycosidases as described by Thotakura et al., 1987, Meth. Enzymol. 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Other modifications of the antibody construct are contemplated herein. For example, another type of covalent modification of the antibody construct comprises linking the antibody construct to various non-proteinaceous polymers, including, but not limited to, various polyols such as polyethylene glycol, polypropylene glycol, polyoxyalkylenes, or copolymers of polyethylene glycol and polypropylene glycol, in the manner set forth in U.S. Pat. Nos. 4,640,835; 4,496,689; 4,301,144; 4,670,417; 4,791,192 or 4,179,337. In addition, as is known in the art, amino acid substitutions may be made in various positions within the antibody construct, e.g. in order to facilitate the addition of polymers such as PEG.

In some embodiments, the covalent modification of the antibody constructs of the invention comprises the addition of one or more labels. The labelling group may be coupled to the antibody construct via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected - the following examples include, but are not limited to:

- a) isotopic labels, which may be radioactive or heavy isotopes, such as radioisotopes or radionuclides (e.g., $^{3}H$, $^{14}C$, $^{15}N$, $^{35}S$, $^{89}Zr$, $^{90}Y$, $^{99}Tc$, $^{111}In$, $^{125}I$, and $^{131}I$)
- b) magnetic labels (e.g., magnetic particles)
- c) redox active moieties
- d) optical dye (including, but not limited to, chromophores, phosphors and fluorophores) such as fluorescent groups (e.g., FITC, rhodamine, lanthanide phosphors), chemiluminescent groups, and fluorophores which can be either "small molecule" fluores or proteinaceous fluores
- e) enzymatic groups (e.g. horseradish peroxidase, β-galactosidase, luciferase, alkaline phosphatase)
- f) biotinylated groups
- g) predetei mined polypeptide epitopes recognized by a secondary reporter (e.g., leucine zipper pair sequences, binding sites for secondary antibodies, metal binding domains, epitope tags, etc.)

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, Oreg.), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in Molecular Probes Handbook by Richard P. Haugland.

Suitable proteinaceous fluorescent labels also include, but are not limited to, green fluorescent protein, including a Renilla, Ptilosarcus, or Aequorea species of GFP (Chalfie et al., 1994, Science 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, Biotechniques 24:462-471; Heim et al., 1996, Curr. Biol. 6:178-182), enhanced yellow fluorescent protein (EYFP, Clontech Laboratories, Inc.), luciferase (Ichiki et al., 1993, J. Immunol. 150:5408-5417), β-galactosidase (Nolan et al., 1988, Proc. Natl. Acad. Sci. U.S.A. 85:2603-2607) and Renilla (W092/15673, W095/07463, W098/14605, W098/26277, W099/49019, U.S. Pat. Nos. 5,292,658, 5,418,155, 5,683,888, 5,741,668, 5,777,079, 5,804,387, 5,874,304, 5,876,995, 5,925,558).

Leucine zipper domains are peptides that promote oligomerization of the proteins in which they are found. Leucine zippers were originally identified in several DNA-binding proteins (Landschulz et al., 1988, Science 240: 1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, FEBS Letters 344:191. The use of a modified leucine zipper that allows for stable trimerization of a heterologous protein fused thereto is described in Fanslow et al., 1994, Semin. Immunol. 6:267-78. In one approach, recombinant fusion proteins comprising CDH19 antibody fragment or derivative fused to a leucine zipper peptide are expressed in suitable host cells, and the soluble oligomeric CDH19 antibody fragments or derivatives that form are recovered from the culture supernatant.

The antibody construct of the invention may also comprise additional domains, which are e.g. helpful in the isolation of the molecule or relate to an adapted pharmacokinetic profile of the molecule. Domains helpful for the isolation of an antibody construct may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. StrepII-tag) and His-tag. All herein disclosed antibody constructs characterized by the identified CDRs are preferred to comprise a His-tag domain, which is generally known as a repeat of consecutive His residues in the amino acid sequence of a molecule, preferably of six His residues.

The first binding domain of the antibody construct of the present invention binds to human CDH19 on the surface of a target cell. The amino acid sequence of human CDH19 is represented by SEQ ID NO: 1834. It is understood that the term "on the surface" means in the context of the present invention that the binding domain specifically binds to an epitope or epitope cluster comprised within the CDH19 extracellular domain (CDH19 ECD). The first binding domain according to the invention hence preferably binds to CDH19 when it is expressed by naturally expressing cells or cell lines, and/or by cells or cell lines transformed or (stably/transiently) transfected with CDH19. In a preferred embodiment the first binding domain also binds to CDH19 when CDH19 is used as a "target" or "ligand" molecule in an in vitro binding assay such as BIAcore or Scatchard. The "target cell" can be any prokaryotic or eukaryotic cell expressing CDH19 on its surface; preferably the target cell is a cell that is part of the human or animal body, such as a melanoma cell.

The term "CDH19 ECD" refers to a form of CDH19 which is essentially free of transmembrane and cytoplasmic domains of CDH19. It will be understood by the skilled artisan that the transmembrane domain identified for the CDH19 polypeptide of the present invention is identified pursuant to criteria routinely employed in the art for identifying that type of hydrophobic domain. The exact boundaries of a transmembrane domain may vary but most likely by no more than about 5 amino acids at either end of the domain specifically mentioned herein. A preferred human CDH19 ECD is shown in SEQ ID NO: 1836.

The affinity of the first binding domain for human CDH19 is preferably ≤15 nM, more preferably ≤10 nM, even more preferably ≤5 nM, even more preferably ≤1 nM, even more preferably ≤0.5 nM, even more preferably ≤0.1 nM, and most preferably ≤0.05 nM. The affinity can be measured for example in a BIAcore™ assay or in a Scatchard assay, e.g. as described in the Examples. Other methods of determining the affinity are well-known to the skilled person.

T cells or T lymphocytes are a type of lymphocyte (itself a type of white blood cell) that play a central role in cell-mediated immunity. There are several subsets of T cells, each with a distinct function. T cells can be distinguished from other lymphocytes, such as B cells and NK cells, by the presence of a T cell receptor (TCR) on the cell surface. The TCR is responsible for recognizing antigens bound to major histocompatibility complex (MHC) molecules and is composed of two different protein chains. In 95% of the T cells, the TCR consists of an alpha (α) and beta (β) chain. When the TCR engages with antigenic peptide and MHC (peptide/MHC complex), the T lymphocyte is activated through a series of biochemical events mediated by associated enzymes, co-receptors, specialized adaptor molecules, and activated or released transcription factors The CD3 receptor complex is a protein complex and is composed of four chains. In mammals, the complex contains a CD3γ (gamma) chain, a CD3δ (delta) chain, and two CD3ε (epsilon) chains. These chains associate with the T cell receptor (TCR) and the so-called ζ (zeta) chain to form the T cell receptor CD3 complex and to generate an activation signal in T lymphocytes. The CD3γ (gamma), CD3δ (delta), and CD3ε (epsilon) chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signaling capacity of the TCR. The CD3 epsilon molecule is a polypeptide which in humans is encoded by the CD3E gene which resides on chromosome 11. The sequence of a preferred human CD3 epsilon extracellular domain is shown in SEQ ID NO: 1844, and the most preferred CD3 binding epitope corresponding to amino acid residues 1-27 of the human CD3 epsilon extracellular domain is represented in SEQ ID NO: 1845.

The redirected lysis of target cells via the recruitment of T cells by a multispecific, at least bispecific, antibody construct involves cytolytic synapse formation and delivery of perforin and granzymes. The engaged T cells are capable of serial target cell lysis, and are not affected by immune escape mechanisms interfering with peptide antigen processing and presentation, or clonal T cell differentiation; see, for example, WO 2007/042261.

Cytotoxicity mediated by CDH19/CD3 bispecific antibody constructs can be measured in various ways. Effector cells can be e.g. stimulated enriched (human) CD8 positive T cells or unstimulated (human) peripheral blood mononuclear cells (PBMC). If the target cells are of macaque origin or express or are transfected with macaque CDH19, the effector cells should also be of macaque origin such as a macaque T cell line, e.g. 4119LnPx. The target cells should express (at least the extracellular domain of) CDH19, e.g. human or macaque CDH19. Target cells can be a cell line (such as CHO) which is stably or transiently transfected with CDH19, e.g. human or macaque CDH19. Alternatively, the target cells can be a CDH19 positive natural expresser cell line, such as the human myeloma cell line CHL-1 or Colo-699. Usually EC50 values are expected to be lower with target cell lines expressing higher levels of CDH19 on the cell surface. The effector to target cell (E:T) ratio is usually about 10:1, but can also vary. Cytotoxic activity of CDH19/CD3 bispecific antibody constructs can be measured in a 51-chromium release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by CDH19/CD3 bispecific antibody constructs of the present invention is preferably measured in a cell-based cytotoxicity assay. It is represented by the EC50 value, which corresponds to the half maximal effective concentration (concentration of the antibody construct which induces a cytotoxic response halfway between the baseline and maximum). Preferably, the EC50 value of the CDH19/CD3 bispecific antibody constructs is ≤20.000 pg/ml, more preferably ≤5000 pg/ml, even more preferably ≤1000 pg/ml, even more preferably ≤500 pg/ml, even more preferably ≤350 pg/ml, even more preferably ≤250 pg/ml, even more preferably ≤100 pg/ml, even more preferably ≤50 pg/ml, even more preferably ≤10 pg/ml, and most preferably ≤5 pg/ml.

Any of the above given EC50 values can be combined with any one of the indicated scenarios of a cell-based cytotoxicity assay. For example, when (human) CD8 positive T cells or a macaque T cell line are used as effector cells, the EC50 value of the CDH19/CD3 bispecific antibody construct is preferably ≤1000 pg/ml, more preferably ≤500 pg/ml, even more preferably ≤250 pg/ml, even more preferably ≤100 pg/ml, even more preferably ≤50 pg/ml, even more preferably ≤10 pg/ml, and most preferably ≤5 pg/ml. If in this assay the target cells are (human or macaque) CDH19 transfected cells such as CHO cells, the EC50 value of the CDH19/CD3 bispecific antibody construct is preferably ≤150 pg/ml, more preferably ≤100 pg/ml, even more preferably ≤50 pg/ml, even more preferably ≤30 pg/ml, even more preferably ≤10 pg/ml, and most preferably ≤5 pg/ml. If the target cells are a CDH19 positive natural expresser cell line, then the EC50 value is preferably ≤350 pg/ml, more preferably ≤250 pg/ml, even more preferably ≤200 pg/ml, even more preferably ≤100 pg/ml, even more preferably ≤150 pg/ml, even more preferably ≤100 pg/ml, and most preferably ≤50 pg/ml, or lower. When (human) PBMCs are used as effector cells, the $EC_{50}$ value of the CDH19/CD3 bispecific antibody construct is preferably ≤1000 pg/ml, more preferably ≤750 pg/ml, more preferably ≤500 pg/ml, even more preferably ≤350 pg/ml, even more preferably ≤250 pg/ml, even more preferably ≤100 pg/ml, and most preferably ≤50 pg/ml, or lower.

Preferably, the CDH19/CD3 bispecific antibody constructs of the present invention do not induce/mediate lysis or do not essentially induce/mediate lysis of CDH19 negative cells such as CHO cells. The term "do not induce lysis", "do not essentially induce lysis", "do not mediate lysis" or "do not essentially mediate lysis" means that an antibody constructs of the present invention does not induce or mediate lysis of more than 30%, preferably not more than 20%, more preferably not more than 10%, particularly preferably not more than 9%, 8%, 7%, 6% or 5% of CDH19 negative cells, whereby lysis of a CDH19 positive cell line such as CHL-1 or Colo-699 is set to be 100%. This usually applies for concentrations of the antibody construct of up to 500 nM. The skilled person knows how to measure cell lysis without further ado. Moreover, the present specification teaches specific instructions how to measure cell lysis.

The difference in cytotoxic activity between the monomeric and the dimeric isoform of individual CDH19/CD3 bispecific antibody constructs is referred to as "potency gap". This potency gap can e.g. be calculated as ratio between $EC_{50}$ values of the molecule's monomeric and dimeric form. Potency gaps of the CDH19/CD3 bispecific antibody constructs of the present invention are preferably ≤5, more preferably ≤4, even more preferably ≤3, even more preferably ≤2 and most preferably ≤1.

The first and/or the second (or any further) binding domain(s) of the antibody construct of the invention is/are preferably cross-species specific for members of the mammalian order of primates. Cross-species specific CD3 binding domains are, for example, described in WO 2008/119567. According to one embodiment, the first and/or second binding domain, in addition to binding to human CDH19 and human CD3, respectively, will also bind to CDH19 /CD3 of primates including (but not limited to) new world primates (such as Callithrix jacchus, Saguinus Oedipus or Saimiri sciureus), old world primates (such as baboons and macaques), gibbons, and non-human homininae.

In one aspect of the invention, the first binding domain binds to human CDH19 and further binds to macaque CDH19, such as CDH19 of Macaca fascicularis (SEQ ID NO: 1835). The affinity of the first binding domain for macaque CDH19 is preferably ≤15 nM, more preferably ≤10 nM, even more preferably ≤5 nM, even more preferably ≤1 nM, even more preferably ≤0.5 nM, even more preferably ≤0.1 nM, and most preferably ≤0.05 nM or even ≤0.01 nM.

Preferably the affinity gap of the antibody constructs according to the invention for binding macaque CDH19 versus human CDH19 [maCDH19:huCDH19] is between 0.1 and 10, more preferably between 0.2 and 5, even more preferably between 0.3 and 2.5, even more preferably between 0.4 and 2, and most preferably between 0.5 and 1.

In one embodiment of the antibody construct of the invention, the second binding domain binds to human and Callithrix jacchus, Saguinus Oedipus or Saimiri sciureus CD3 epsilon. Callithrix jacchus and Saguinus oedipus are both new world primate belonging to the family of Callitrichidae, while Saimiri sciureus is a new world primate belonging to the family of Cebidae.

It is particularly preferred for the antibody construct of the present invention that the second binding domain which binds to human CD3 on the surface of a T cell comprises a VL region comprising CDR-L1, CDR-L2 and CDR-L3 selected from:
(a) CDR-L1 as depicted in SEQ ID NO: 27 of WO 2008/119567, CDR-L2 as depicted in SEQ ID NO: 28 of WO 2008/119567 and CDR-L3 as depicted in SEQ ID NO: 29 of WO 2008/119567;
(b) CDR-L1 as depicted in SEQ ID NO: 117 of WO 2008/119567, CDR-L2 as depicted in SEQ ID NO: 118 of WO 2008/119567 and CDR-L3 as depicted in SEQ ID NO: 119 of WO 2008/119567; and
(c) CDR-L1 as depicted in SEQ ID NO: 153 of WO 2008/119567, CDR-L2 as depicted in SEQ ID NO: 154 of WO 2008/119567 and CDR-L3 as depicted in SEQ ID NO: 155 of WO 2008/119567.

In an alternatively preferred embodiment of the antibody construct of the present invention, the second binding domain which binds to human CD3 on the surface of a T cell comprises a VH region comprising CDR-H 1, CDR-H2 and CDR-H3 selected from:

(a) CDR-H1 as depicted in SEQ ID NO: 12 of WO 2008/119567, CDR-H2 as depicted in SEQ ID NO: 13 of WO 2008/119567 and CDR-H3 as depicted in SEQ ID NO: 14 of WO 2008/119567;
(b) CDR-H1 as depicted in SEQ ID NO: 30 of WO 2008/119567, CDR-H2 as depicted in SEQ ID NO: 31 of WO 2008/119567 and CDR-H3 as depicted in SEQ ID NO: 32 of WO 2008/119567;
(c) CDR-H1 as depicted in SEQ ID NO: 48 of WO 2008/119567, CDR-H2 as depicted in SEQ ID NO: 49 of WO 2008/119567 and CDR-H3 as depicted in SEQ ID NO: 50 of WO 2008/119567;
(d) CDR-H1 as depicted in SEQ ID NO: 66 of WO 2008/119567, CDR-H2 as depicted in SEQ ID NO: 67 of WO 2008/119567 and CDR-H3 as depicted in SEQ ID NO: 68 of WO 2008/119567;
(e) CDR-H1 as depicted in SEQ ID NO: 84 of WO 2008/119567, CDR-H2 as depicted in SEQ ID NO: 85 of WO 2008/119567 and CDR-H3 as depicted in SEQ ID NO: 86 of WO 2008/119567;
(f) CDR-H1 as depicted in SEQ ID NO: 102 of WO 2008/119567, CDR-H2 as depicted in SEQ ID NO: 103 of WO 2008/119567 and CDR-H3 as depicted in SEQ ID NO: 104 of WO 2008/119567;
(g) CDR-H1 as depicted in SEQ ID NO: 120 of WO 2008/119567, CDR-H2 as depicted in SEQ ID NO: 121 of WO 2008/119567 and CDR-H3 as depicted in SEQ ID NO: 122 of WO 2008/119567;
(h) CDR-H1 as depicted in SEQ ID NO: 138 of WO 2008/119567, CDR-H2 as depicted in SEQ ID NO: 139 of WO 2008/119567 and CDR-H3 as depicted in SEQ ID NO: 140 of WO 2008/119567;
(i) CDR-H1 as depicted in SEQ ID NO: 156 of WO 2008/119567, CDR-H2 as depicted in SEQ ID NO: 157 of WO 2008/119567 and CDR-H3 as depicted in SEQ ID NO: 158 of WO 2008/119567; and
(j) CDR-H1 as depicted in SEQ ID NO: 174 of WO 2008/119567, CDR-H2 as depicted in SEQ ID NO: 175 of WO 2008/119567 and CDR-H3 as depicted in SEQ ID NO: 176 of WO 2008/119567.

It is further preferred for the antibody construct of the present invention that the second binding domain which binds to human CD3 on the surface of a T cell comprises a VL region selected from the group consisting of a VL region as depicted in SEQ ID NO: 35, 39, 125, 129, 161 or 165 of WO 2008/119567.

It is alternatively preferred that the second binding domain which binds to human CD3 on the surface of a T cell comprises a VH region selected from the group consisting of a VH region as depicted in SEQ ID NO: 15, 19, 33, 37, 51, 55, 69, 73, 87, 91, 105, 109, 123, 127, 141, 145, 159, 163, 177 or 181 of WO 2008/119567.

More preferably, the antibody construct of the present invention is characterized by the second binding domain which binds to human CD3 on the surface of a T cell comprising a VL region and a VH region selected from the group consisting of:
(a) a VL region as depicted in SEQ ID NO: 17 or 21 of WO 2008/119567 and a VH region as depicted in SEQ ID NO: 15 or 19 of WO 2008/119567;
(b) a VL region as depicted in SEQ ID NO: 35 or 39 of WO 2008/119567 and a VH region as depicted in SEQ ID NO: 33 or 37 of WO 2008/119567;
(c) a VL region as depicted in SEQ ID NO: 53 or 57 of WO 2008/119567 and a VH region as depicted in SEQ ID NO: 51 or 55 of WO 2008/119567;

(d) a VL region as depicted in SEQ ID NO: 71 or 75 of WO 2008/119567 and a VH region as depicted in SEQ ID NO: 69 or 73 of WO 2008/119567;
(e) a VL region as depicted in SEQ ID NO: 89 or 93 of WO 2008/119567 and a VH region as depicted in SEQ ID NO: 87 or 91 of WO 2008/119567;
(f) a VL region as depicted in SEQ ID NO: 107 or 111 of WO 2008/119567 and a VH region as depicted in SEQ ID NO: 105 or 109 of WO 2008/119567;
(g) a VL region as depicted in SEQ ID NO: 125 or 129 of WO 2008/119567 and a VH region as depicted in SEQ ID NO: 123 or 127 of WO 2008/119567;
(h) a VL region as depicted in SEQ ID NO: 143 or 147 of WO 2008/119567 and a VH region as depicted in SEQ ID NO: 141 or 145 of WO 2008/119567;
(i) a VL region as depicted in SEQ ID NO: 161 or 165 of WO 2008/119567 and a VH region as depicted in SEQ ID NO: 159 or 163 of WO 2008/119567; and
(j) a VL region as depicted in SEQ ID NO: 179 or 183 of WO 2008/119567 and a VH region as depicted in SEQ ID NO: 177 or 181 of WO 2008/119567.

According to a preferred embodiment of the antibody construct of the present invention, the binding domains and in particular the second binding domain (which binds to human CD3 on the surface of a T cell) have the following format: The pairs of VH regions and VL regions are in the format of a single chain antibody (scFv). The VH and VL regions are arranged in the order VH-VL or VL-VH. It is preferred that the VH-region is positioned N-terminally to a linker sequence, and the VL-region is positioned C-terminally of the linker sequence.

A preferred embodiment of the above described antibody construct of the present invention is characterized by the second binding domain which binds to human CD3 on the surface of a T cell comprising an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567.

In one embodiment of the present invention, the antibody construct has an amino acid sequence selected from the group consisting of those sequences as depicted in
(a) SEQ ID NO: 26, SEQ ID NO: 39, SEQ ID NO: 52, SEQ ID NO: 65, SEQ ID NO: 78, SEQ ID NO: 91, SEQ ID NO: 104, SEQ ID NO: 117, SEQ ID NO: 130, SEQ ID NO: 143, SEQ ID NO: 156, SEQ ID NO: 169, SEQ ID NO: 182, SEQ ID NO: 195, SEQ ID NO: 208, SEQ ID NO: 221, SEQ ID NO: 234, SEQ ID NO: 247, SEQ ID NO: 260, SEQ ID NO: 273, SEQ ID NO: 286, SEQ ID NO: 299, SEQ ID NO: 312, SEQ ID NO: 325, SEQ ID NO: 520, SEQ ID NO: 533, SEQ ID NO: 546, SEQ ID NO: 559, SEQ ID NO: 572, SEQ ID NO: 585, SEQ ID NO: 598, SEQ ID NOs 613-636 and 651-658, SEQ ID NOs 660-683 and 698-705, SEQ ID NOs: 707-730 and 745-752, SEQ ID NOs: 754-777 and 792-799, SEQ ID NOs: 801-824 and 839-846, SEQ ID NOs: 848-871 and 886-893, SEQ ID NOs: 895-918 and 933-940, SEQ ID NOs: 942-965 and 980-987, SEQ ID NOs: 989-1012 and 1027-1034, SEQ ID NOs: 1036-1059 and 1074-1081, SEQ ID NOs: 1083-1106 and 1121-1128, SEQ ID NOs: 1130-1153 and 1168-1175, SEQ ID NOs: 1177-1200 and 1215-1222, SEQ ID NOs: 1224-1247 and 1262-1269, SEQ ID NOs: 1271-1294 and 1309-1316, SEQ ID NOs: 1318-1341 and 1356-1363, SEQ ID NOs: 1365-1388 and 1403-1410, SEQ ID NOs: 1412-1435 and 1450-1457, SEQ ID NOs: 1459-1482 and 1497-1504, SEQ ID NOs: 1506-1529 and 1544-1551, SEQ ID NOs: 1553-1576 and 1591-1598, SEQ ID NOs: 1600-1623 and 1638-1645, SEQ ID NOs: 1647-1670 and 1685-1692, SEQ ID NOs: 1694-1717 and 1732-1739, SEQ ID NOs: 1741-1764 and 1779-1786, SEQ ID NOs: 1788-1811 and 1826-1833; and
(b) SEQ ID NO: 13, SEQ ID NO: 338, SEQ ID NO: 351, SEQ ID NO: 364, SEQ ID NO: 377, SEQ ID NO: 390, SEQ ID NO: 403, SEQ ID NO: 416, SEQ ID NO: 429, SEQ ID NO: 442, SEQ ID NO: 455, SEQ ID NO: 468, SEQ ID NO: 481, SEQ ID NO: 494, SEQ ID NO: 507, SEQ ID NO: 611, SEQ ID NOs: 612 and 637-650, SEQ ID NOs: 659 and 684-697, SEQ ID NOs: 706 and 731-744, SEQ ID NOs: 753 and 778-791, SEQ ID NOs: 800 and 825-838, SEQ ID NOs: 847 and 872-885, SEQ ID NOs: 894 and 919-932, SEQ ID NOs: 941 and 966-979, SEQ ID NOs: 988 and 1013-1026, SEQ ID NOs: 1035 and 1060-1073, SEQ ID NOs: 1082 and 1107-1120, SEQ ID NOs: 1129 and 1154-1167, SEQ ID NOs: 1176 and 1201-1214, SEQ ID NOs: 1223 and 1248-1261, SEQ ID NOs: 1270 and 1295-1308, SEQ ID NOs: 1317 and 1342-1355, SEQ ID NOs: 1364 and 1389-1402, SEQ ID NOs: 1411 and 1436-1449, SEQ ID NOs: 1458 and 1483-1496, SEQ ID NOs: 1505 and 1530-1543, SEQ ID NOs: 1552 and 1577-1590, SEQ ID NOs: 1599 and 1624-1637, SEQ ID NOs: 1646 and 1671-1684, SEQ ID NOs: 1693 and 1718-1731, SEQ ID NOs: 1740 and 1765-1778, SEQ ID NOs: 1787 and 1812-1825.

Amino acid sequence modifications of the antibody constructs described herein are also contemplated. For example, it may be desirable to improve the binding affinity and/or other biological properties of the antibody construct. Amino acid sequence variants of the antibody constructs are prepared by introducing appropriate nucleotide changes into the antibody constructs nucleic acid, or by peptide synthesis. All of the below described amino acid sequence modifications should result in an antibody construct which still retains the desired biological activity (binding to CDH19 and to CD3) of the unmodified parental molecule.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

Amino acid modifications include, for example, deletions from, and/or insertions into, and/or substitutions of, residues within the amino acid sequences of the antibody constructs. Any combination of deletion, insertion, and substitution is made to arrive at the final construct, provided that the final construct possesses the desired characteristics. The amino acid changes also may alter post-translational processes of the antibody constructs, such as changing the number or position of glycosylation sites.

For example, 1, 2, 3, 4, 5, or 6 amino acids may be inserted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted or deleted in each of the FRs. Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intra-sequence insertions of single or multiple amino acid residues. An insertional variant of the antibody construct of the invention includes the fusion to the N-terminus or to the C-terminus of the antibody construct to an enzyme or a fusion to a polypeptide which increases the serum half-life of the antibody construct.

The sites of greatest interest for substitutional mutagenesis include the CDRs of the heavy and/or light chain, in particular the hypervariable regions, but FR alterations in the heavy and/or light chain are also contemplated. The substitutions are preferably conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

A useful method for identification of certain residues or regions of the antibody constructs that are preferred locations for mutagenesis is called "alanine scanning mutagenesis" as described by Cunningham and Wells in Science, 244: 1081-1085 (1989). Here, a residue or group of target residues within the antibody construct is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions then are refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning or random mutagenesis may be conducted at a target codon or region, and the expressed antibody construct variants are screened for the optimal combination of desired activity. Techniques for making substitution mutations at predetermined sites in the DNA having a known sequence are well known, for example, M13 primer mutagenesis and PCR mutagenesis. Screening of the mutants is done using assays of antigen binding activities, such as CDH19 binding.

Generally, if amino acids are substituted in one or more or all of the CDRs of the heavy and/or light chain, it is preferred that the then-obtained "substituted" sequence is at least 60%, more preferably 65%, even more preferably 70%, particularly preferably 75%, more particularly preferably 80% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 1, below) is envisaged as long as the antibody construct retains its capability to bind to CDH19 via the first binding domain and to CD3 epsilon via the second binding domain and/or its CDRs have an identity to the then substituted sequence (at least 60%, more preferably 65%, even more preferably 70%, particularly preferably 75%, more particularly preferably 80% identical to the "original" CDR sequence).

Conservative substitutions are shown in Table 1 under the heading of "preferred substitutions". If such substitutions result in a change in biological activity, then more substantial changes, denominated "exemplary substitutions" in Table A, or as further described below in reference to amino acid classes, may be introduced and the products screened for a desired characteristic.

TABLE A

Amino acid substitutions

| Original | Exemplary Substitutions | Preferred Substitutions |
|---|---|---|
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |
| Glu (E) | asp, gln | asp |
| Gly (G) | Ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | Ala | ala |
| Ser (S) | Thr | thr |
| Thr (T) | Ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; (3) acidic: asp, glu; (4) basic: asn, gin, his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody construct may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

For amino acid sequences, sequence identity and/or similarity is determined by using standard techniques known in the art, including, but not limited to, the local sequence identity algorithm of Smith and Waterman, 1981, Adv. Appl.

Math. 2:482, the sequence identity alignment algorithm of Needleman and Wunsch, 1970, J. Mol. Biol. 48:443, the search for similarity method of Pearson and Lipman, 1988, Proc. Nat. Acad. Sci. U.S.A. 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, Nucl. Acid Res. 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, J. Mol. Evol. 35:351-360; the method is similar to that described by Higgins and Sharp, 1989, CABIOS 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, J. Mol. Biol. 215:403-410; Altschul et al., 1997, Nucleic Acids Res. 25:3389-3402; and Karin et al., 1993, Proc. Natl. Acad. Sci. U.S.A. 90:5873-5787. A particularly useful BLAST program is the WU-BLAST-2 program which was obtained from Altschul et al., 1996, Methods in Enzymology 266: 460-480. WU-BLAST-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, Nucl. Acids Res. 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs are at least 60% to the sequences depicted herein, and more typically with preferably increasing homologies or identities of at least 65% or 70%, more preferably at least 75% or 80%, even more preferably at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antibody construct. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs and the nucleotide sequences depicted herein are at least 60%, and more typically with preferably increasing homologies or identities of at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Thus, a "variant CDR" is one with the specified homology, similarity, or identity to the parent CDR of the invention, and shares biological function, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR.

In one embodiment, the bispecific antibody constructs of the present invention exhibit high monomer yields under standard research scale conditions, e.g., in a standard two-step purification process. Preferably the monomer yield of the antibody constructs according to the invention is ≥0.25 mg/L supernatant, more preferably ≥0.5 mg/L, even more preferably ≥1 mg/L, and most preferably ≥3 mg/L supernatant.

Likewise, the yield of the dimeric antibody construct isoforms and hence the monomer percentage (i.e., monomer: (monomer+dimer)) of the antibody constructs can be determined. The productivity of monomeric and dimeric antibody constructs and the calculated monomer percentage can e.g. be obtained in the SEC purification step of culture supernatant from standardized research-scale production in roller bottles. In one embodiment, the monomer percentage of the antibody constructs is ≥80%, more preferably ≥85%, even more preferably ≥90%, and most preferably ≥95%.

In a further embodiment, the percentage of identity to human germline of the antibody constructs according to the invention is ≥70% or ≥75%, more preferably ≥80% or ≥85%, even more preferably ≥90%, and most preferably ≥95%. Identity to human antibody germline gene products is thought to be an important feature to reduce the risk of therapeutic proteins to elicit an immune response against the drug in the patient during treatment. Hwang & Foote ("Immunogenicity of engineered antibodies"; Methods 36 (2005) 3-10) demonstrate that the reduction of non-human portions of drug antibody constructs leads to a decrease of risk to induce anti-drug antibodies in the patients during treatment. By comparing an exhaustive number of clinically evaluated antibody drugs and the respective immunogenicity data, the trend is shown that humanization of the V-regions of antibodies makes the protein less immunogenic (average 5.1% of patients) than antibodies carrying unaltered non-human V regions (average 23.59% of patients). A higher degree of identity to human sequences is hence desirable for V-region based protein therapeutics in the form of antibody constructs. For this purpose of determining the germline identity, the V-regions of VL can be aligned with the amino acid sequences of human germline V segments and J segments (http://vbase.mrc-cpe.cam.ac.uk/) using Vector NTI software and the amino acid sequence calculated by dividing the identical amino acid residues by the total number of amino acid residues of the VL in percent. The same can be for the VH segments (http://vbase.mrc-cpe.cam.ac.uk/) with the exception that the VH CDR3 may be excluded due to its high diversity and a lack of existing human germline VH CDR3 alignment partners. Recombinant techniques can then be used to increase sequence identity to human antibody germline genes.

In one embodiment, the antibody constructs have a preferred plasma stability (ratio of EC50 with plasma to EC50 w/o plasma) of ≤5, more preferably ≤4, even more preferably ≤3, and most preferably ≤2. The plasma stability of an antibody construct can be tested by incubation of the construct in human plasma at 37° C. for 24 hours followed by EC50 determination in a 51chromium release cytotoxicity assay. The effector cells in the cytotoxicity assay can be stimulated enriched human CD8 positive T cells. Target cells can e.g. be CHO cells transfected with human CDH19. The effector to target cell (E:T) ratio can be chosen as 10:1. The human plasma pool used for this purpose is derived from the blood of healthy donors collected by EDTA coated syringes. Cellular components are removed by centrifugation and the upper plasma phase is collected and subsequently pooled. As control, antibody constructs are diluted immediately prior to the cytotoxicity assay in RPMI-1640 medium. The plasma stability is calculated as ratio of EC50 (after plasma incubation) to EC50 (control).

It is preferred that the monomer to dimer conversion of antibody constructs of the invention is low. The conversion can be measured under different conditions and analyzed by high performance size exclusion chromatography. For example, incubation of the monomeric isoforms of the antibody constructs can be carried out for 7 days at 37° C. and concentrations of e.g. 100 µg/ml or 250 µg/ml in an incubator. Under these conditions, it is preferred that the antibody constructs of the invention show a dimer percentage that is ≤5%, more preferably ≤4%, even more preferably ≤3%, even more preferably ≤2.5%, even more preferably ≤2%, even more preferably ≤1.5%, and most preferably ≤1%.

It is also preferred that the bispecific antibody constructs of the present invention present with very low dimer conversion after a number of freeze/thaw cycles. For example, the antibody construct monomer is adjusted to a concentration of 250 µg/ml e.g. in SEC running buffer and subjected to three freeze/thaw cycles (freezing at −80° C. for 30 min followed by thawing for 30 min at room temperature), followed by high performance SEC to determine the percentage of initially monomeric antibody construct, which had been converted into dimeric antibody construct. Preferably the dimer percentages of the bispecific antibody constructs are ≤5%, more preferably ≤4%, even more preferably ≤3%, even more preferably ≤2.5%, even more preferably ≤2%, even more preferably ≤1.5%, and most preferably ≤1%, for example after three freeze/thaw cycles.

The bispecific antibody constructs of the present invention preferably show a favorable thermostability with melting temperatures above 60° C. This parameter can be determined as follows: Temperature melting curves are determined by Differential Scanning Calorimetry (DSC) to determine intrinsic biophysical protein stabilities of the antibody constructs. These experiments are performed using a MicroCal LLC (Northampton, Mass., U.S.A) VP-DSC device. The energy uptake of a sample containing an antibody construct is recorded from 20° C. to 90° C. compared to a sample containing only the formulation buffer. The antibody constructs are adjusted to a final concentration of 250 µg/ml e.g. in SEC running buffer. For recording of the respective melting curve, the overall sample temperature is increased stepwise. At each temperature T energy uptake of the sample and the formulation buffer reference is recorded. The difference in energy uptake Cp (kcal/mole/° C.) of the sample minus the reference is plotted against the respective temperature. The melting temperature is defined as the temperature at the first maximum of energy uptake.

In a further embodiment the antibody construct according to the invention is stable at acidic pH. The more tolerant the antibody construct behaves at unphysiologic pH such as pH 5.5 (a pH which is required to run e.g. a cation exchange chromatography), the higher is the recovery of the antibody construct eluted from an ion exchange column relative to the total amount of loaded protein. Recovery of the antibody construct from an ion (e.g., cation) exchange column at pH 5.5 is preferably ≥30%, more preferably ≥40%, more preferably ≥50%, even more preferably ≥60%, even more preferably ≥70%, even more preferably ≥80%, and most preferably ≥90%.

It is furthermore envisaged that the bispecific antibody constructs of the present invention exhibit therapeutic efficacy or anti-tumor activity. This can e.g. be assessed in a study as disclosed in the following example of an advanced stage human tumor xenograft model:

On day 1 of the study, 5×106 cells of a human CDH19 positive cancer cell line are subcutaneously injected in the right dorsal flank of female NOD/SCID mice. When the mean tumor volume reaches about 100 mm3, in vitro expanded human CD3 positive T cells are transplanted into the mice by injection of about 2×107 cells into the peritoneal cavity of the animals. Mice of vehicle control group 1 do not receive effector cells and are used as an untransplanted control for comparison with vehicle control group 2 (receiving effector cells) to monitor the impact of T cells alone on tumor growth. The antibody treatment starts when the mean tumor volume reaches about 200 mm3. The mean tumor size of each treatment group on the day of treatment start should not be statistically different from any other group (analysis of variance). Mice are treated with 0.5 mg/kg/day of a CDH19/CD3 bispecifc antibody construct by intravenous bolus injection for about 15 to 20 days. Tumors are measured by caliper during the study and progress evaluated by intergroup comparison of tumor volumes (TV). The tumor growth inhibition T/C [%] is determined by calculating TV as T/C %=100×(median TV of analyzed group)/(median TV of control group 2).

The skilled person knows how to modify or adapt certain parameters of this study, such as the number of injected tumor cells, the site of injection, the number of transplanted human T cells, the amount of bispecific antibody constructs to be administered, and the timelines, while still arriving at a meaningful and reproducible result. Preferably, the tumor growth inhibition T/C [%] is ≤70 or ≤60, more preferably ≤50 or ≤40, even more preferably ≤30 or ≤20 and most preferably ≤10 or ≤5 or even ≤2.5.

The invention further provides a polynucleotide/nucleic acid molecule encoding an antibody construct of the invention.

A polynucleotide is a biopolymer composed of 13 or more nucleotide monomers covalently bonded in a chain. DNA (such as cDNA) and RNA (such as mRNA) are examples of polynucleotides with distinct biological function. Nucleotides are organic molecules that serve as the monomers or subunits of nucleic acid molecules like DNA or RNA. The nucleic acid molecule or polynucleotide can be double stranded and single stranded, linear and circular. It is preferably comprised in a vector which is preferably comprised in a host cell. Said host cell is, e.g. after transformation or transfection with the vector or the polynucleotide of the invention, capable of expressing the antibody construct. For that purpose the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because the vast majority of genes are encoded with exactly the same code, this particular code is often referred to as the canonical or standard genetic code. While the genetic code determines the protein sequence for a given coding region, other genomic regions can influence when and where these proteins are produced.

Furthermore, the invention provides a vector comprising a polynucleotide/nucleic acid molecule of the invention.

A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using calcium phosphate, by electroporation, by cell squeezing or by mixing a cationic lipid with the material to produce liposomes, which fuse with the cell membrane and deposit their cargo inside.

The term "transformation" is used to describe non-viral transfer of nucleic acid molecules or polynucleotides (including vectors) into bacteria, and also into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules). Transformation can be effected by artificial means. For transformation to happen, cells or bacteria must be in a state of competence, which might occur as a time-limited response to environmental conditions such as starvation and cell density.

Moreover, the invention provides a host cell transformed or transfected with the polynucleotide/nucleic acid molecule or with the vector of the invention.

As used herein, the terms "host cell" or "recipient cell" are intended to include any individual cell or cell culture that can be or has/have been recipients of vectors, exogenous nucleic acid molecules, and polynucleotides encoding the antibody construct of the present invention; and/or recipients of the antibody construct itself. The introduction of the respective material into the cell is carried out by way of transformation, transfection and the like. The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell, but is still included within the scope of the term as used herein. Suitable host cells include prokaryotic or eukaryotic cells, and also include but are not limited to bacteria, yeast cells, fungi cells, plant cells, and animal cells such as insect cells and mammalian cells, e.g., murine, rat, macaque or human.

The antibody construct of the invention can be produced in bacteria. After expression, the antibody construct of the invention is isolated from the *E. coli* cell paste in a soluble fraction and can be purified through, e.g., affinity chromatography and/or size exclusion. Final purification can be carried out similar to the process for purifying antibody expressed e.g., in CHO cells.

In addition to prokaryotes, eukaryotic microbes such as filamentous fungi or yeast are suitable cloning or expression hosts for the antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe, Kluyveromyces* hosts such as *K. lactis, K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans*, and *K. marxianus; yarrowia* (EP 402 226); *Pichia pastoris* (EP 183 070); *Candida; Trichoderma reesia* (EP 244 234); *Neurospora crassa; Schwanniomyces* such as *Schwanniomyces occidentalis*; and filamentous fungi such as *Neurospora, Penicillium, Tolypocladium,* and *Aspergillus* hosts such as *A. nidulans* and *A. niger.*

Suitable host cells for the expression of glycosylated antibody construct of the invention are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx mori* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, *petunia*, tomato, *Arabidopsis* and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36: 59 (1977)); baby hamster kidney cells (BHK, ATCC CCL 10); Chinese hamster ovary cells/-DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2,1413 8065); mouse mammary tumor (MMT 060562, ATCC CCL5 1); TRI cells (Mather et al., Annals N. Y Acad. Sci. (1982) 383: 44-68); MRC 5 cells; FS4 cells; and a human hepatoma line (Hep G2).

In a further embodiment the invention provides a process for the production of an antibody construct of the invention, said process comprising culturing a host cell of the invention under conditions allowing the expression of the antibody construct of the invention and recovering the produced antibody construct from the culture.

As used herein, the term "culturing" refers to the in vitro maintenance, differentiation, growth, proliferation and/or propagation of cells under suitable conditions in a medium. The term "expression" includes any step involved in the production of an antibody construct of the invention including, but not limited to, transcription, post-transcriptional modification, translation, post-translational modification, and secretion.

When using recombinant techniques, the antibody construct can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody construct of the invention prepared from the host cells can be recovered or purified using, for example, hydroxylapatite chromatography, gel electrophoresis, dialysis, and affinity chromatography. Other techniques for protein purification such as fractionation on an ion-exchange column, ethanol precipitation, Reverse Phase HPLC, chromatography on silica, chromatography on heparin SEPHAROSE™, chromatography on an anion or cation exchange resin (such as a polyaspartic acid column), chromato-focusing, SDS-PAGE, and ammonium sulfate precipitation are also available depending on the antibody to be recovered. Where the antibody construct of the invention comprises a CH3 domain, the Bakerbond ABX resin (J. T. Baker, Phillipsburg, N.J.) is useful for purification.

Affinity chromatography is a preferred purification technique. The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose.

Moreover, the invention provides a pharmaceutical composition comprising an antibody construct of the invention or an antibody construct produced according to the process of the invention.

As used herein, the term "pharmaceutical composition" relates to a composition which is suitable for administration to a patient, preferably a human patient. The particularly preferred pharmaceutical composition of this invention comprises one or a plurality of the antibody construct(s) of the invention, preferably in a therapeutically effective amount. Preferably, the pharmaceutical composition further comprises suitable formulations of one or more (pharmaceutically effective) carriers, stabilizers, excipients, diluents, solubilizers, surfactants, emulsifiers, preservatives and/or adjuvants. Acceptable constituents of the composition are preferably nontoxic to recipients at the dosages and concentrations employed. Pharmaceutical compositions of the invention include, but are not limited to, liquid, frozen, and lyophilized compositions.

The inventive compositions may comprise a pharmaceutically acceptable carrier. In general, as used herein, "pharmaceutically acceptable carrier" means any and all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with pharmaceutical administration, in particular with parenteral administration. The use of such media and agents in pharmaceutical compositions is well known in the art, and the compositions comprising such carriers can be formulated by well-known conventional methods.

Certain embodiments provide pharmaceutical compositions comprising the antibody construct of the invention and further one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter.

In certain embodiments, the pharmaceutical composition may contain formulation materials for the purpose of modifying, maintaining or preserving, e.g., the pH, osmolarity, viscosity, clarity, color, isotonicity, odor, sterility, stability, rate of dissolution or release, adsorption or penetration of the composition (see, REMINGTON'S PHARMACEUTICAL SCIENCES, 18" Edition, (A. R. Genrmo, ed.), 1990, Mack Publishing Company). In such embodiments, suitable formulation materials may include, but are not limited to:

- amino acids such as glycine, alanine, glutamine, asparagine, threonine, proline, 2-phenylalanine, including charged amino acids, preferably lysine, lysine acetate, arginine, glutamate and/or histidine
- antimicrobials such as antibacterial and antifungal agents
- antioxidants such as ascorbic acid, methionine, sodium sulfite or sodium hydrogen-sulfite;
- buffers, buffer systems and buffering agents which are used to maintain the composition at physiological pH or at a slightly lower pH, typically within a pH range of from about 5 to about 8 or 9; examples of buffers are borate, bicarbonate, Tris-HCl, citrates, phosphates or other organic acids, succinate, phosphate, histidine and acetate; for example Tris buffer of about pH 7.0-8.5, or acetate buffer of about pH 4.0-5.5;
- non-aqueous solvents such as propylene glycol, polyethylene glycol, vegetable oils such as olive oil, and injectable organic esters such as ethyl oleate;
- aqueous carriers including water, alcoholic/aqueous solutions, emulsions or suspensions, including saline and buffered media;
- biodegradable polymers such as polyesters;
- bulking agents such as mannitol or glycine;
- chelating agents such as ethylenediamine tetraacetic acid (EDTA);
- isotonic and absorption delaying agents;
- complexing agents such as caffeine, polyvinylpyrrolidone, beta-cyclodextrin or hydroxypropyl-beta-cyclodextrin)
- fillers;
- monosaccharides; disaccharides; and other carbohydrates (such as glucose, mannose or dextrins); carbohydrates may be non-reducing sugars, preferably trehalose, sucrose, octasulfate, sorbitol or xylitol;
- (low molecular weight) proteins, polypeptides or proteinaceous carriers such as human or bovine serum albumin, gelatin or immunoglobulins, preferably of human origin;
- coloring and flavouring agents;
- sulfur containing reducing agents, such as glutathione, thioctic acid, sodium thioglycolate, thioglycerol, [alpha]-monothioglycerol, and sodium thio sulfate
- diluting agents;
- emulsifying agents;
- hydrophilic polymers such as polyvinylpyrrolidone)
- salt-forming counter-ions such as sodium;
- preservatives such as antimicrobials, anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide);
- metal complexes such as Zn-protein complexes;
- solvents and co-solvents (such as glycerin, propylene glycol or polyethylene glycol);
- sugars and sugar alcohols, such as trehalose, sucrose, octasulfate, mannitol, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; and polyhydric sugar alcohols;
- suspending agents;
- surfactants or wetting agents such as pluronics, PEG, sorbitan esters, polysorbates such as polysorbate 20, polysorbate, triton, tromethamine, lecithin, cholesterol, tyloxapal; surfactants may be detergents, preferably with a molecular weight of >1.2 KD and/or a polyether, preferably with a molecular weight of >3 KD; non-limiting examples for preferred detergents are Tween 20, Tween 40, Tween 60, Tween 80 and Tween 85; non-limiting examples for preferred polyethers are PEG 3000, PEG 3350, PEG 4000 and PEG 5000;
- stability enhancing agents such as sucrose or sorbitol;
- tonicity enhancing agents such as alkali metal halides, preferably sodium or potassium chloride, mannitol sorbitol;
- parenteral delivery vehicles including sodium chloride solution, Ringer's dextrose, dextrose and sodium chloride, lactated Ringer's, or fixed oils;
- intravenous delivery vehicles including fluid and nutrient replenishers, electrolyte replenishers (such as those based on Ringer's dextrose).

It is evident to those skilled in the art that the different constituents of the pharmaceutical composition (e.g., those listed above) can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

It is envisaged that the composition of the invention might comprise, in addition to the polypeptide of the invention defined herein, further biologically active agents, depending on the intended use of the composition. Such agents might be drugs acting on the gastrointestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antibody construct of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In certain embodiments, the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the antibody construct of the invention may be formulated as a lyophilizate using appropriate excipients such as sucrose.

When parenteral administration is contemplated, the therapeutic compositions for use in this invention may be provided in the form of a pyrogen-free, parenterally acceptable aqueous solution comprising the desired antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antibody construct.

Additional pharmaceutical compositions will be evident to those skilled in the art, including formulations involving the antibody construct of the invention in sustained- or controlled-delivery/release formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481), copolymers of L-glutamic acid and gamma ethyl-L-glutamate (Sidman et al., 1983, Biopolymers 2:547-556), poly(2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(-)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949.

The antibody construct may also be entrapped in microcapsules prepared, for example, by coacervation techniques or by interfacial polymerization (for example, hydroxymethylcellulose or gelatine-microcapsules and poly(methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Another aspect of the invention includes self-buffering antibody construct of the invention formulations, which can be used as pharmaceutical compositions, as described in international patent application WO 06138181A2 (PCT/US2006/022599). A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution," in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions," Pharm Biotechnol. 13: 159-75 (2002), see particularly the parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention. As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic." Destabilizing solutes are referred to as "chaotropic." Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in the antibody construct of the invention formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations. Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the antibody construct of the invention formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188. Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of the antibody construct of the invention formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard. Antioxidants can damage proteins. For instance, reducing agents, such as glutathione in particular, can disrupt intramolecular disulfide linkages. Thus, antioxidants for use in the invention are selected to, among other things, eliminate or sufficiently reduce the possibility of themselves damaging proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins. Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by $Al^{+3}$ ions.

Embodiments of the antibody construct of the invention formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized—dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

The antibody constructs disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody construct are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544, 545; and WO 97/38731. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody construct of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4): 1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g. metabolism, excretion, etc. By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma. "Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of bispecific antibody constructs exhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

In one embodiment the invention provides the antibody construct of the invention or the antibody construct produced according to the process of the invention for use in the prevention, treatment or amelioration of a melanoma disease or a metastatic melanoma disease.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient having melanoma/metastatic melanoma as specified herein, by the administration of an antibody construct according to the invention to a subject in need thereof. Such an improvement may also be seen as a slowing or stopping of the progression of the (metastatic) melanoma disease of the patient. The term "prevention" as used herein means the avoidance of the occurrence or re-occurrence of a patient having melanoma/ metastatic melanoma as specified herein, by the administration of an antibody construct according to the invention to a subject in need thereof.

The term "disease" refers to any condition that would benefit from treatment with the antibody construct or the pharmaceutic composition described herein. This includes chronic and acute disorders or diseases including those pathological conditions that predispose the mammal to the disease in question. A "melanoma disease" is a type of skin cancer which forms from melanocytes. In metastatic melanoma, brain metastases are particularly common, but the term "metatstatic melanoma disease" also encompasses metastases to the liver, bones, skin, heart, lung, abdomen, (distant) lymph nodes.

In a preferred embodiment of the invention, the melanoma disease or metastatic melanoma disease is selected from the group consisting of superficial spreading melanoma (SSM), lentigo maligna (also known as "lentiginous melanoma on sun-damaged skin"), lentigo maligna melanoma, acral lentiginous melanoma, nodular melanoma (NM, also including the subtype Polypoid melanoma), mucosal melanoma, desmoplastic melanoma, amelanotic melanoma, and soft-tissue melanoma.

The invention also provides a method for the treatment or amelioration of a melanoma disease or a metastatic melanoma disease, comprising the step of administering to a subject in need thereof the antibody construct of the invention or the antibody construct produced according to the process of the invention.

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. In the context of the present invention, the routes of administration include, but are not limited to topical routes (such as epicutaneous, inhalational, nasal, opthalmic, auricular/aural, vaginal, mucosal);
enteral routes (such as oral, gastrointestinal, sublingual, sublabial, buccal, rectal); and
parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions of the present invention can be administered to the subject at a suitable dose which can be determined e.g. by dose escalating studies by administration of increasing doses of the antibody construct of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A typical dosage may range from about 0.1 µg/kg to up to about 30 mg/kg or more, depending on the factors mentioned above. In specific embodiments, the dosage may range from 1.0 µg/kg up to about 20 mg/kg, optionally from 10 µg/kg up to about 10 mg/kg or from 100 µg/kg up to about 5 mg/kg.

A therapeutic effective amount of an antibody construct of the invention preferably results in a decrease in severity of disease symptoms, an increase in frequency or duration of disease symptom-free periods or a prevention of impairment or disability due to the disease affliction. For treating CDH19-expressing tumors, a therapeutically effective amount of the antibody construct of the invention, e.g. an anti-CDH19/anti-CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy in human tumors.

The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the antibody construct of the invention as defined herein or separately before or after administration of said antibody construct in timely defined intervals and doses.

The term "effective and non-toxic dose" as used herein refers to a tolerable dose of an inventive antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

In a further embodiment, the invention provides a kit comprising an antibody construct of the invention, an antibody construct produced according to the process of the invention, a vector of the invention, and/or a host cell of the invention.

In the context of the present invention, the term "kit" means two or more components—one of which corresponding to the antibody construct, the pharmaceutical composition, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct and a second recipient comprising an aqueous formulation. In certain embodiments of this invention, kits containing single-chambered and multi-chambered pre-filled syringes (e.g., liquid syringes and lyosyringes) are provided.

Figure 1:
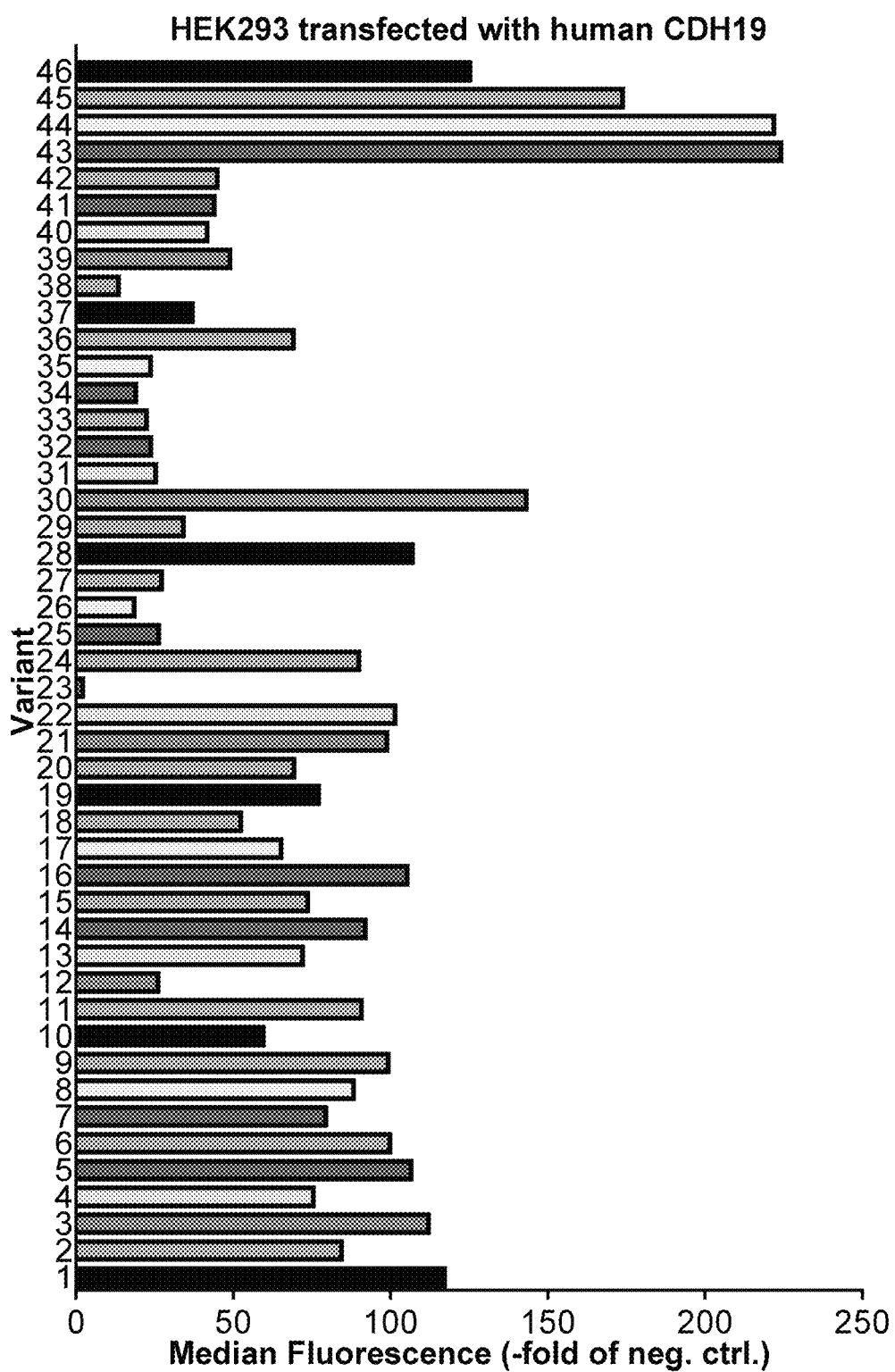
FIG. 1: Binding of CDH19 specific BiTE antibodies to human CDH19 expressing HEK293 cells. CHO cell culture supernatant was used as first step reagent for an immunofluorescence staining of human CDH19 expressing HEK293 cells, followed by detection with a mouse anti-His and a phycoerythrin-conjugated anti-mouse antibody. The fluorescence was determined by flow cytometry.
Figure 2:
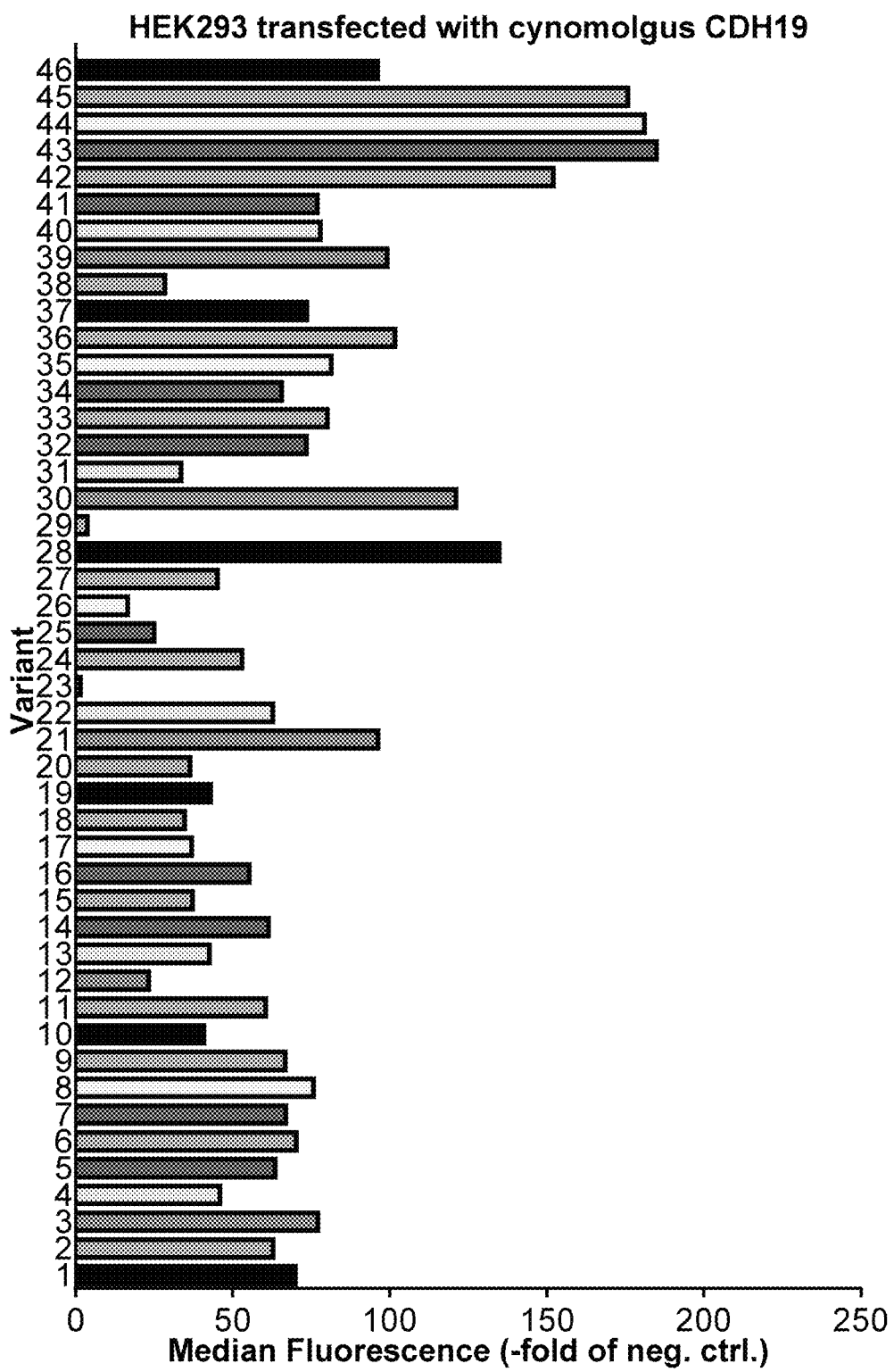
FIG. 2: Binding of CDH19 specific BiTE antibodies to cynomolgus CDH19 expressing HEK293 cells. CHO cell culture supernatant was used as first step reagent for an immunofluorescence staining of cynomolgus CDH19 expressing HEK293 cells, followed by detection with a mouse anti-His and a phycoerythrin-conjugated anti-mouse antibody. The fluorescence was determined by flow cytometry.
Figure 3:
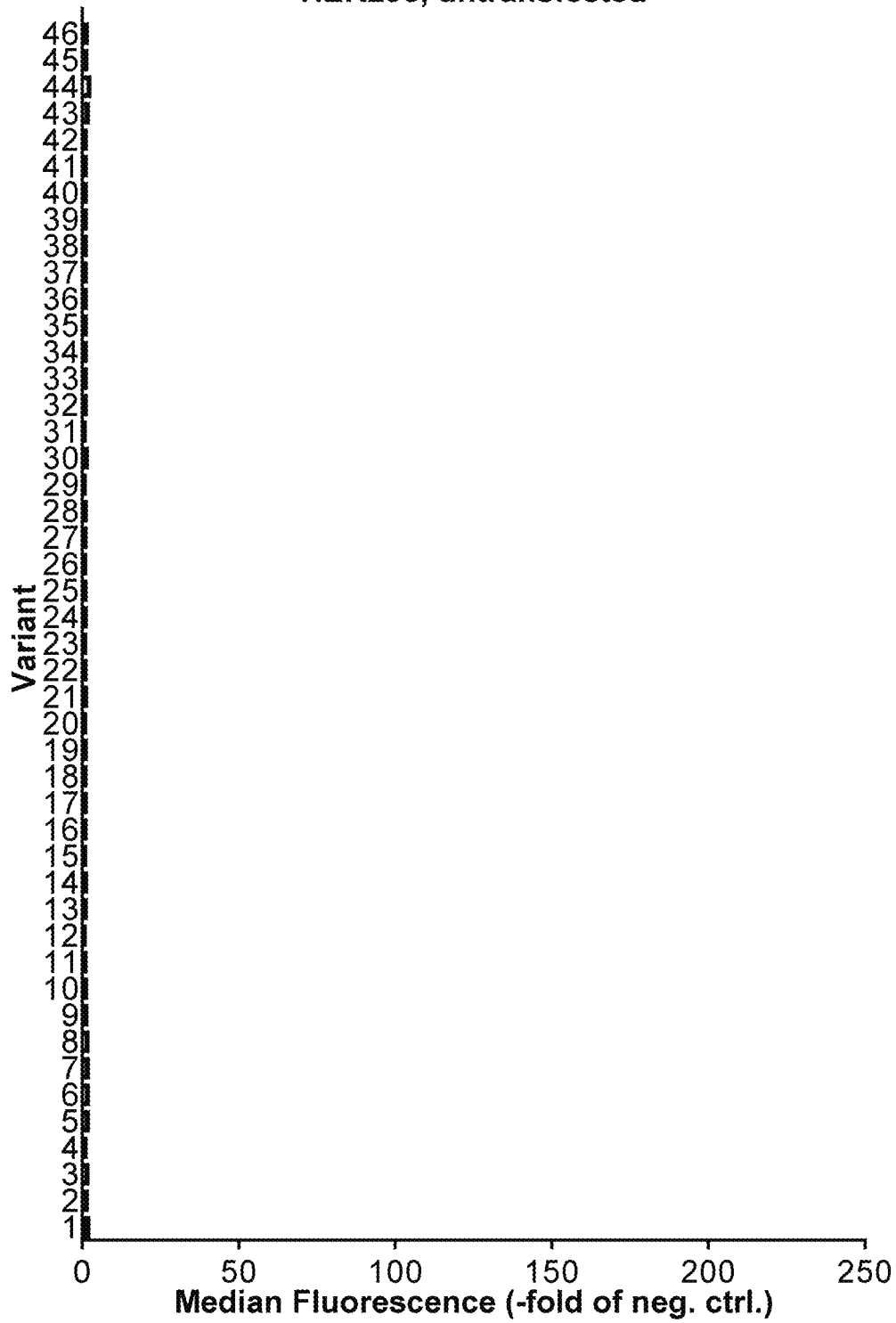
FIG. 3: Binding of CDH19 specific BiTE antibodies to untransfected HEK293 cells. CHO cell culture supernatant was used as first step reagent for an immunofluorescence staining of untransfected HEK293 cells, followed by detection with a mouse anti-His and a phycoerythrin-conjugated anti-mouse antibody. The fluorescence was determined by flow cytometry.
Figure 4:
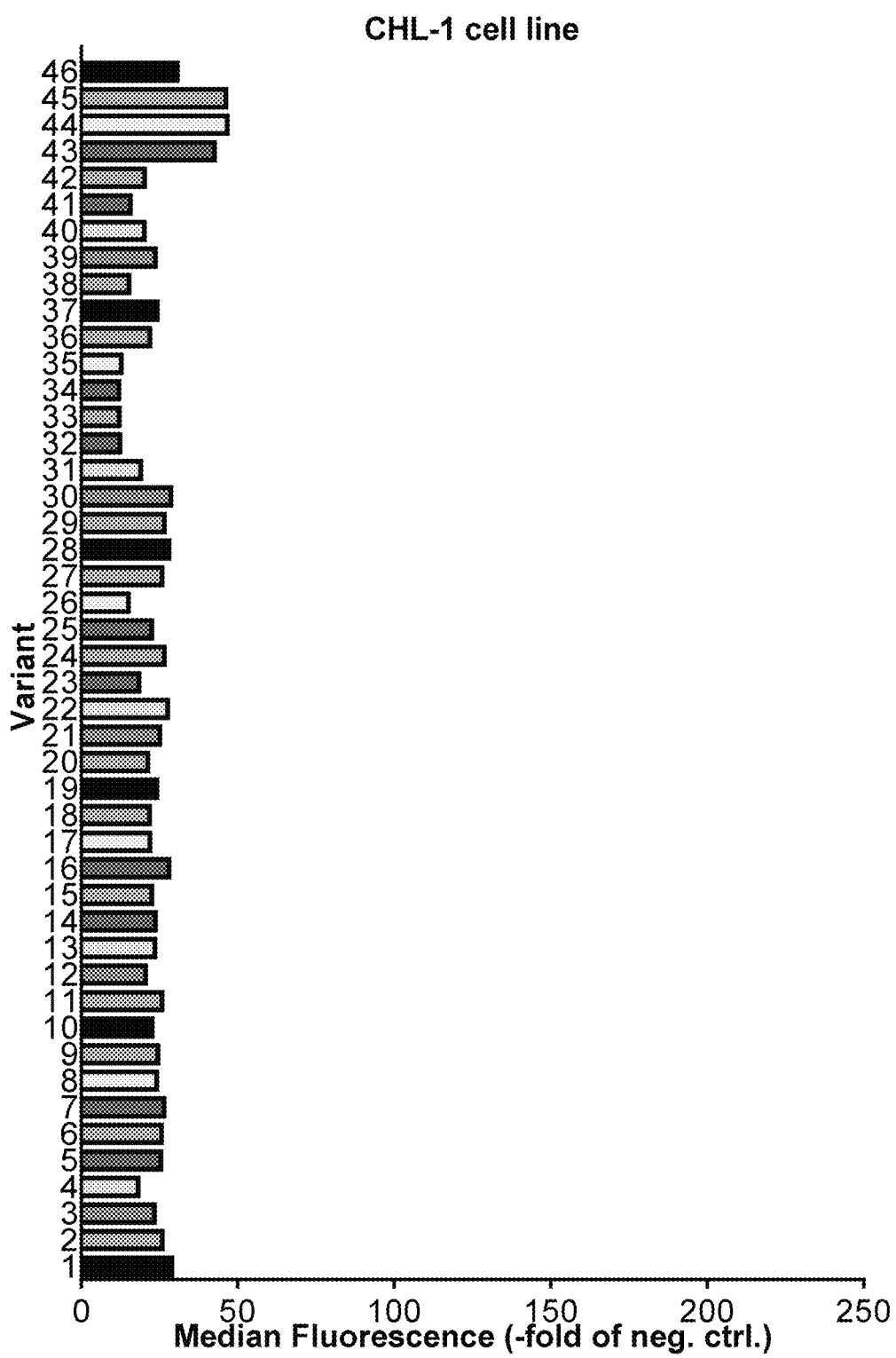
FIG. 4: Binding of CDH19 specific BiTE antibodies to the cell line CHL-1. CHO cell culture supernatant was used as first step reagent for an immunofluorescence staining of CHL-1 cells, followed by detection with a mouse anti-His and a phycoerythrin-conjugated anti-mouse antibody. The fluorescence was determined by flow cytometry.

On chimeric chicken/human CDH19-constructs sharing representative examples of each epitope cluster found within the totality of tested CDH19-binders. HEK cells transfected with chicken or human CDH19, or with chimeric CDH19 molecules were used for epitope mapping of periplasmic extracts containing anti-human and macaque CDH19-scFv. Bound scFv were detected with an anti-HIS antibody and a PE-labeled anti-mouse Fc gamma-specific antibody. Left: designation of CDH19 scFv, top row: term of transfected HEK cells. Histogram figures: red box: gain of binding due to exchange of the chicken CDH19 sequence by the homologous human CDH19 sequence thus identifying the epitope or part of the epitope of the tested scFv. Abbreviations: wt: wildtype, hu: human, ck: chicken.

It should be understood that the inventions herein are not limited to particular methodology, protocols, or reagents, as such can vary. The discussion and examples provided herein are presented for the purpose of describing particular embodiments only and are not intended to limit the scope of the present invention, which is defined solely by the claims.

All publications and patents cited throughout the text of this specification (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

EXAMPLES

The following examples are provided for the purpose of illustrating specific embodiments or features of the present invention. These examples should not be construed as to limit the scope of this invention. The examples are included for purposes of illustration, and the present invention is limited only by the claims.

Example 1

Interspecies CDH19 Cross-reactivity

To confirm binding to human and cynomolgus CDH19, 46 different CDH19 BiTE antibodies were tested by flow cytometry using the following cell lines: i) HEK293 cells transfected with N-terminally FLAG-tagged human CDH19, ii) HEK293 cells transfected with N-terminally FLAG-tagged cynomolgus CDH19, iii) untransfected HEK293 cells, iv) the human melanoma cell line CHL-1 expressing native human CDH19 (Table 1).

For flow cytometry 200,000 cells of the respective cell lines were incubated on ice for 30 min with 50 µl of CHO cell culture supernatant containing secreted BiTE molecules. Cell culture supernatant of untransfected cells was used as a negative control. The cells were washed twice in PBS/1% FCS/0.05% Na-Azide and binding of the constructs was detected with a murine anti-His antibody (clone AD1.1.10, AbD Serotec), diluted 1:1000 in 50 µl PBS/1% FCS/0.05% Na-Azide). After washing, bound anti-His antibodies were detected with a phycoerythrin-conjugated mouse Fc gamma-specific antibody (Dianova), diluted 1:100 in PBS/1% FCS/0.05% Na-Azide. Fluorescence signals of the cells were measured by flow cytometry on a FACSCanto II instrument and analyzed by FACSDiva software (both from Becton Dickinson).

As a result, the CDH19/CD3 bispecific antibodies stained HEK293 cells transfected with human CDH19, cynomolgus CDH19 and the human CDH19-expressing melanoma cell line CHL-1. Moreover, no staining of untransfected HEK293 cells could be observed (see Figure—Figure). BiTE antibody 23 shows only weak binding to HEK293 cells expressing human CDH19 or cynomolgus CDH19 but clear binding to CHL-1 cells indicating a N-terminal CDH19 epitope which may be altered by the N-FLAG-tag of the recombinantly expressed CDH19 proteins on the respective transfected HEK293 cells.

TABLE 1

| CDH19 BiTE antibodies and assigned numbers. | |
| --- | --- |
| BiTE antibody name | BiTE antibody number |
| CH19_4-H8 | 1 |
| CH19_6-A7 | 2 |
| CH19_6-B8 | 3 |

TABLE 1-continued

CDH19 BiTE antibodies and assigned numbers.

| BiTE antibody name | BiTE antibody number |
| --- | --- |
| CH19_6-C12 | 4 |
| CH19_6-E12 | 5 |
| CH19_6-F9 | 6 |
| CH19_6-G8 | 7 |
| CH19_4-A7 | 8 |
| CH19_9-F1 | 9 |
| CH19_9-F9 | 10 |
| CH19_0-B4 | 11 |
| CH19_0-C11 | 12 |
| CH19_1-H8 | 13 |
| CH19_2-E4 | 14 |
| CH19_0-B8 | 15 |
| CH19_0-C4 | 16 |
| CH19_0-G4 | 17 |
| CH19_0-H5 | 18 |
| CH19_1-B12 | 19 |
| CH19_1-D11 | 20 |
| CH19_1-G11 | 21 |
| CH19_1-H11 | 22 |
| CH19_2-G6 | 23 |
| CH19_5-G4 | 24 |
| CH19_8-F6 | 25 |
| CH19_0-G9 | 26 |
| CH19_2-A10 | 27 |
| CH19_2-D9 | 28 |
| CH19_2-H7 | 29 |
| CH19_0-E11 | 30 |
| CH19_1-E11 | 31 |
| CH19_8-H6 | 32 |
| CH19_8-H7 | 33 |
| CH19_9-C2 | 34 |
| CH19_9-F3 | 35 |
| CH19_0-F5 | 36 |
| CH19_1-E1 | 37 |
| CH19_1-E6 | 38 |
| CH19_3-B10 | 39 |
| CH19_3-F2 | 40 |
| CH19_2-C11 | 41 |
| CH19_3-D5 | 42 |
| CH19_5-B3 | 43 |
| CH19_5-E10 | 44 |
| CH19_6-G10 | 45 |
| CH19_203-VKG | 46 |

Example 2

Cytotoxic Activity

Target Cell Labeling

For the analysis of cell lysis in flow cytometry assays, the fluorescent membrane dye DiOC18 (DiO) (Molecular Probes, #V22886) was used to label cynomolgus CDH19 positive CHO cells—as target cells and distinguish them from effector cells. Briefly, cells were harvested, washed once with PBS and adjusted to 106 cell/mL in PBS containing 2% (v/v) FBS and the membrane dye DiO (5 µL/106 cells). After incubation for 3 min at 37° C., cells were washed twice in complete RPMI medium and the cell number adjusted to 1.25×105 cells/mL. The vitality of cells was determined using 0.5% (v/v) isotonic EosinG solution (Roth, #45380).

Flow Cytometry Based Analysis

This assay was designed to quantify the lysis of cynomolgus CDH19-transfected CHO cells in the presence of serial dilutions of CDH19 bispecific antibodies.

Equal volumes of DiO-labeled target cells and effector cells (i.e. CD3-expressing macaque T cell line 4119LnPx) were mixed, resulting in an E:T cell ratio of 10:1. 160 µL of this suspension were transferred to each well of a 96-well plate. 40 µL of serial dilutions of the CDH19 bispecific antibodies and a negative control bispecific (an CD3-based bispecific antibody recognizing an irrelevant target antigen) or RPMI complete medium as an additional negative control were added. The bispecific antibody-mediated cytotoxic reaction proceeded for 48 hours in a 7% CO2 humidified incubator. Then cells were transferred to a new 96-well plate and loss of target cell membrane integrity was monitored by adding propidium iodide (PI) at a final concentration of 1 µg/mL. PI is a membrane impermeable dye that normally is excluded from viable cells, whereas dead cells take it up and become identifiable by fluorescent emission.

Samples were measured by flow cytometry on a FAC-SCanto II instrument and analyzed by FACSDiva software (both from Becton Dickinson).

Target cells were identified as DiO-positive cells. PI-negative target cells were classified as living target cells. Percentage of cytotoxicity was calculated according to the following formula:

$$\text{Cytotoxicity } [\%] = \frac{n_{dead\ target\ cells}}{n_{target\ cells}} \times 100$$

$n$ = number of events

Using GraphPad Prism 6 software (Graph Pad Software, San Diego), the percentage of cytotoxicity was plotted against the corresponding bispecific antibody concentrations. Dose response curves were analyzed with the four parametric logistic regression models for evaluation of sigmoid dose response curves with fixed hill slope and EC50 values were calculated.

Example 3

Epitope Prediction by Human/Chicken Cadherin-19 Chimeras

Domain binding was determined by flowcytometry on 293T cells transiently transfected with plasmids consisting of single human CDH19 cadherin repeat domain replacements into the chicken Cadherin19 backbone cloned into the pTT5 expression vector immediately preceded by native human or chicken CDH19 leader sequences and a Flag tag. The experiment included assaying a subset of anti-CDH19 antibodies against chicken Cadherin19 to determine suitability for binning on these human/chicken chimeras.

The following binding assay was completed in 96-well V-bottom plates. 50,000 transiently transfected 293T cells were incubated with periplasmic extracts containing scFv binding to human and macaque CDH19. Bound scFv were detected with 1 µg/ml of a monoclonal mouse anti-HIS antibody (AbD Serotec MCA1396). After washing, bound anti-His antibodies were detected with a Fc gamma-specific antibody conjugated to phycoerythrin (Jackson-ImmunoResearch 115-116-071) diluted 1:100.

Cells were then washed one time and measured by flowcytometry on a FACS Calibur instrument (Becton Dickinson) and analyzed by FlowJo software (Version 7.6).

The experiments included HEK 293 controls. As negative control, cells were incubated in PBS with 2% FCS instead of periplasmic extracts containing anti-CDH19 scFv.

The FLAG tag was detected with 1 µg/ml of a FLAG M2 antibody (Sigma F1804) followed by a Fc gamma-specific antibody conjugated to phycoerythrin (Jackson-ImmunoResearch 115-116-071).

Antibodies used for this assay (anti-HIS antibody (AbD Serotec MCA1396), FLAG M2 antibody (Sigma F1804) and the PE-labeled Fc gamma-specific antibody (Jackson-Immuno-Research 115-116-071) were diluted in PBS with 2% FCS. Cells were incubated with the respective antibodies for 30 minutes at 4° C.

Figure 5:
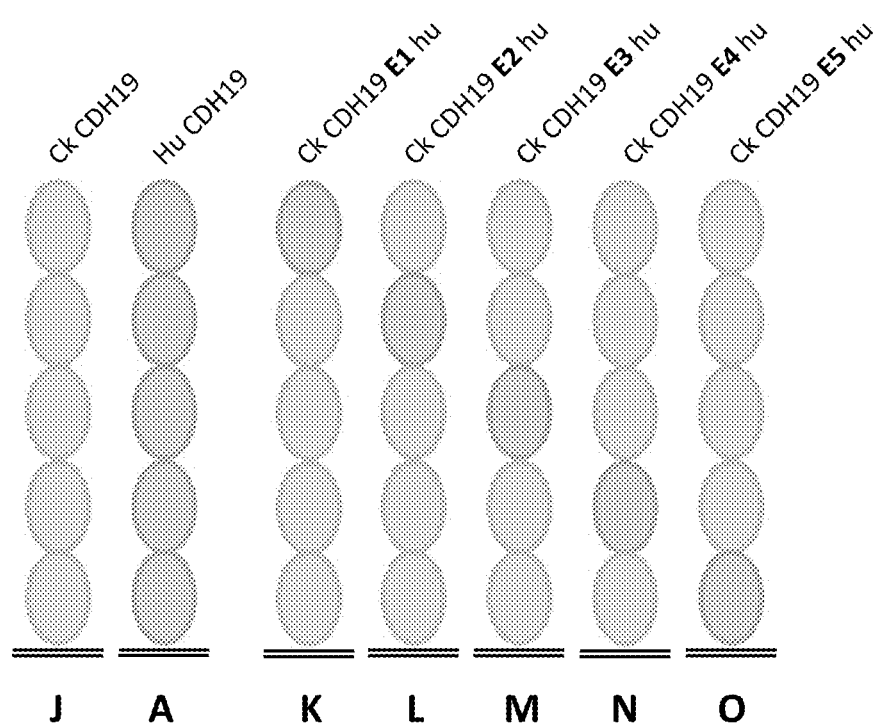
FIG. 5: Human and/or chicken chimera constructs used for the Epitope Prediction for the CDH19 binding domains of the invention.
A=huCDH19(44-772) (see SEQ ID NO: 1843)
J=ckCDH19(44-776) (see SEQ ID NO: 1837)
K=huCDH19(44-141)::ckCDH19(142-776) (see SEQ ID NO: 1838)
L=ckCDH19(44-141)::huCDH19(142-249)::ckCDH19(250-776) (see SEQ ID NO: 1839)
M=ckCDH19(44-249)::huCDH19(250-364)::ckCDH19(365-776) (see SEQ ID NO: 1840)
N=ckCDH19(44-364)::huCDH19(365-463)::ckCDH19(469-776) (see SEQ ID NO: 1841)
O=ckCDH19(44-468)::huCDH19(464-772) (see SEQ ID NO: 1842)
Figure 6:
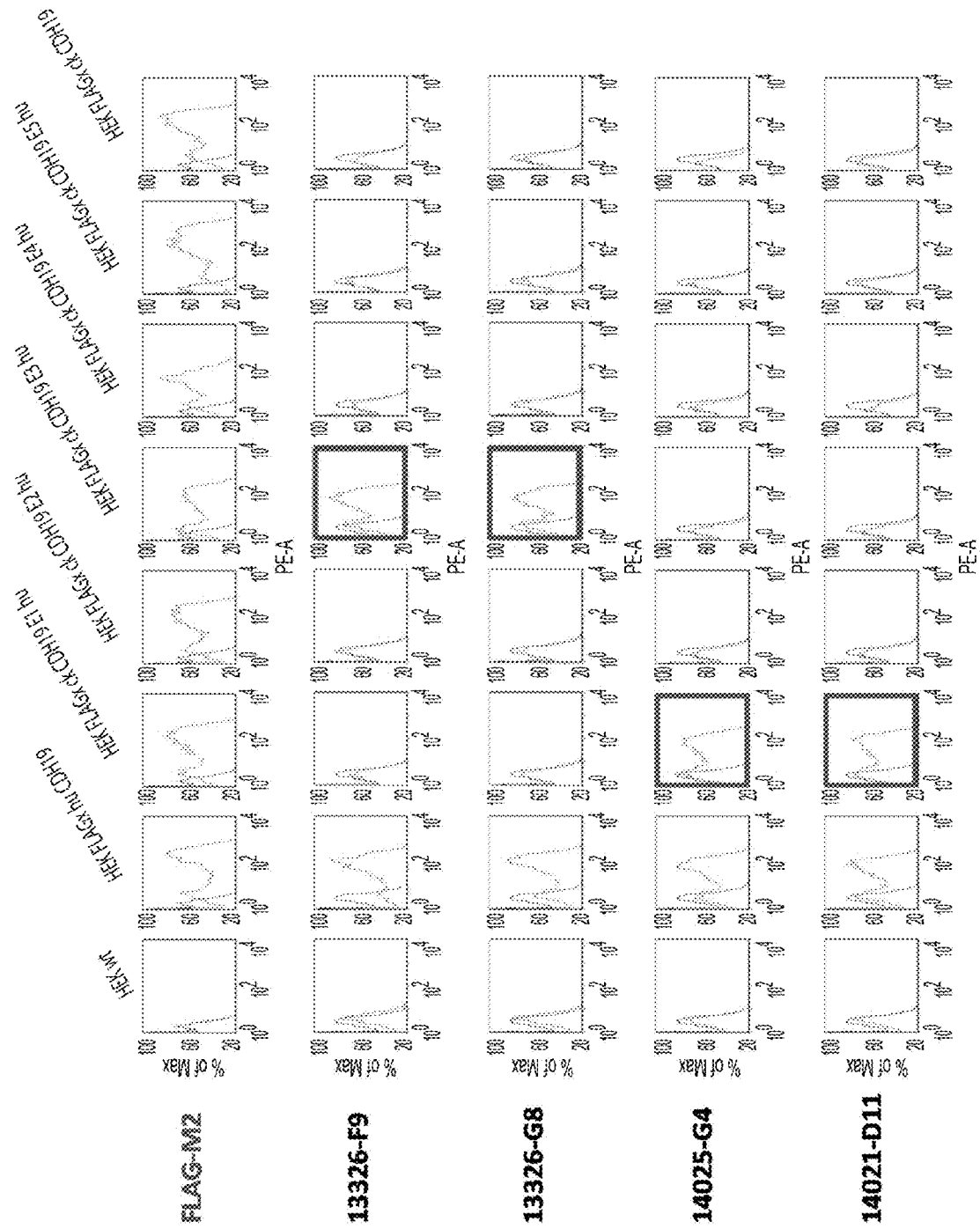
FIG. 6: Epitope clustering of anti-CDH19 scFv shown by flowcytometry

The data from these experiments are presented in FIGS. 5 and 6. Table 2 summarises the conclusion of those assay for the antibody constructs of the invention.

TABLE 2

Epitope Cluster prediction for CDH19 antibody constructs of the invention

| Clon | Epitope cluster | Clon | Epitope cluster |
|---|---|---|---|
| CH19_2G6_302_VKGxI2C6 | E3 | CH19_2-H7xI2C6 | E1 |
| CH19_0-E11xI2C6 | E1 | CH19_5-B3xI2C6 | E3 |
| CH19_5-G4xI2C6 | E1 | CH19_5-E10xI2C6 | E3 |
| CH19_8-H6xI2C6 | E1 | CH19_6-G10xI2C6 | E3 |
| CH19_2-C11xI2C6 | E1 | CH19_4-H8xI2C6 | E3 |
| CH19_2-A10xI2C6 | E1 | CH19_2-E4xI2C6 | E3 |
| CH19_1-D11 xI2C6 | E1 | CH19_6-B8xI2C6 | E3 |

TABLE 2-continued

Epitope Cluster prediction for CDH19 antibody constructs of the invention

| Clon | Epitope cluster | Clon | Epitope cluster |
|---|---|---|---|
| CH19_9-F9xI2C6 | E1 | CH19_0-B4xI2C6 | E3 |
| CH19_1-H8xI2C6 | E1 | CH19_9-F1xI2C6 | E3 |
| CH19_1-B12xI2C6 | E1 | CH19_4-A7xI2C6 | E3 |
| CH19_0-C4xI2C6 | E1 | CH19_6-E12xI2C6 | E3 |
| CH19_3-F2xI2C6 | E1 | CH19_6-C12xI2C6 | E3 |
| CH19_3-B10xI2C6 | E1 | CH19_6-A7xI2C6 | E3 |
| CH19_0-G4xI2C6 | E1 | CH19_6-G8xI2C6 | E3 |
| CH19_0-H5xI2C6 | E1 | CH19_6-F9xI2C6 | E3 |
| CH19_0-B8xI2C6 | E1 | CH19_0-C11xI2C6 | E1 |
| CH19_2-D9xI2C6 | E1 | CH19_8-F6xI2C6 | E1 |
| CH19_8-H7xI2C6 | E1 | CH19_0-G9xI2C6 | E1 |
| CH19_9-C2xI2C6 | E1 | CH19_1-E11xI2C6 | E1 |
| CH19_3-D5xI2C6 | E1 | CH19_0-F5xI2C6 | E1 |
| CH19_1-G11xI2C6 | E1 | CH19_1-E1xI2C6 | E1 |
| CH19_1-H11xI2C6 | E1 | CH19_1-E6xI2C6 | E1 |
| CH19_9-F3xI2C6 | E1 | CH19_2G6_302xI2C6 | E3 |
| CH19_2-G6xI2C6 | E1 | | |

The following table provides sequence identifiers and descriptions for the sequences provided in the sequence listing (the table can be read by scrolling down each column and proceeding left-to-right across columns on a given page).

Sequence Table

| Ab | HCDR1 | HCDR2 | HCDR3 | LCDR1 | LCDR2 | LCDR3 |
|---|---|---|---|---|---|---|
| CH19_2G6_302_VKGxI2C6 | (SEQ ID 1) | (SEQ ID 2) | (SEQ ID 3) | (SEQ ID 4) | (SEQ ID 5) | (SEQ ID 6) |
| CH19_0-E11xI2C6 | (SEQ ID 14) | (SEQ ID 15) | (SEQ ID 16) | (SEQ ID 17) | (SEQ ID 18) | (SEQ ID 19) |
| CH19_5-G4xI2C6 | (SEQ ID 27) | (SEQ ID 28) | (SEQ ID 29) | (SEQ ID 30) | (SEQ ID 31) | (SEQ ID 32) |
| CH19_8-H6xI2C6 | (SEQ ID 40) | (SEQ ID 41) | (SEQ ID 42) | (SEQ ID 43) | (SEQ ID 44) | (SEQ ID 45) |
| CH19_2-C11xI2C6 | (SEQ ID 53) | (SEQ ID 54) | (SEQ ID 55) | (SEQ ID 56) | (SEQ ID 57) | (SEQ ID 58) |
| CH19_2-A10xI2C6 | (SEQ ID 66) | (SEQ ID 67) | (SEQ ID 68) | (SEQ ID 69) | (SEQ ID 70) | (SEQ ID 71) |
| CH19_1-D11xI2C6 | (SEQ ID 79) | (SEQ ID 80) | (SEQ ID 81) | (SEQ ID 82) | (SEQ ID 83) | (SEQ ID 84) |
| CH19_9-F9xI2C6 | (SEQ ID 92) | (SEQ ID 93) | (SEQ ID 94) | (SEQ ID 95) | (SEQ ID 96) | (SEQ ID 97) |
| CH19_1-H8xI2C6 | (SEQ ID 105) | (SEQ ID 106) | (SEQ ID 107) | (SEQ ID 108) | (SEQ ID 109) | (SEQ ID 110) |
| CH19_1-B12xI2C6 | (SEQ ID 118) | (SEQ ID 119) | (SEQ ID 120) | (SEQ ID 121) | (SEQ ID 122) | (SEQ ID 123) |
| CH19_0-C4xI2C6 | (SEQ ID 131) | (SEQ ID 132) | (SEQ ID 133) | (SEQ ID 134) | (SEQ ID 135) | (SEQ ID 136) |
| CH19_3-F2xI2C6 | (SEQ ID 144) | (SEQ ID 145) | (SEQ ID 146) | (SEQ ID 147) | (SEQ ID 148) | (SEQ ID 149) |
| CH19_3-B10xI2C6 | (SEQ ID 157) | (SEQ ID 158) | (SEQ ID 159) | (SEQ ID 160) | (SEQ ID 161) | (SEQ ID 162) |
| CH19_0-G4xI2C6 | (SEQ ID 170) | (SEQ ID 171) | (SEQ ID 172) | (SEQ ID 173) | (SEQ ID 174) | (SEQ ID 175) |
| CH19_0-H5xI2C6 | (SEQ ID 183) | (SEQ ID 184) | (SEQ ID 185) | (SEQ ID 186) | (SEQ ID 187) | (SEQ ID 188) |
| CH19_0-B8xI2C6 | (SEQ ID 196) | (SEQ ID 197) | (SEQ ID 198) | (SEQ ID 199) | (SEQ ID 200) | (SEQ ID 201) |
| CH19_2-D9xI2C6 | (SEQ ID 209) | (SEQ ID 210) | (SEQ ID 211) | (SEQ ID 212) | (SEQ ID 213) | (SEQ ID 214) |
| CH19_8-H7xI2C6 | (SEQ ID 222) | (SEQ ID 223) | (SEQ ID 224) | (SEQ ID 225) | (SEQ ID 226) | (SEQ ID 227) |
| CH19_9-C2xI2C6 | (SEQ ID 235) | (SEQ ID 236) | (SEQ ID 237) | (SEQ ID 238) | (SEQ ID 239) | (SEQ ID 240) |
| CH19_3-D5xI2C6 | (SEQ ID 248) | (SEQ ID 249) | (SEQ ID 250) | (SEQ ID 251) | (SEQ ID 252) | (SEQ ID 253) |
| CH19_1-G11xI2C6 | (SEQ ID 261) | (SEQ ID 262) | (SEQ ID 263) | (SEQ ID 264) | (SEQ ID 265) | (SEQ ID 266) |
| CH19_1-H11xI2C6 | (SEQ ID 274) | (SEQ ID 275) | (SEQ ID 276) | (SEQ ID 277) | (SEQ ID 278) | (SEQ ID 279) |

-continued

| Sequence Table | | | | | | |
|---|---|---|---|---|---|---|
| CH19_9-F3xI2C6 | (SEQ ID 287) | (SEQ ID 288) | (SEQ ID 289) | (SEQ ID 290) | (SEQ ID 291) | (SEQ ID 292) |
| CH19_2-G6xI2C6 | (SEQ ID 300) | (SEQ ID 301) | (SEQ ID 302) | (SEQ ID 303) | (SEQ ID 304) | (SEQ ID 305) |
| CH19_2-H7xI2C6 | (SEQ ID 313) | (SEQ ID 314) | (SEQ ID 315) | (SEQ ID 316) | (SEQ ID 317) | (SEQ ID 318) |
| CH19_5-B3xI2C6 | (SEQ ID 326) | (SEQ ID 327) | (SEQ ID 328) | (SEQ ID 329) | (SEQ ID 330) | (SEQ ID 331) |
| CH19_5-E10xI2C6 | (SEQ ID 339) | (SEQ ID 340) | (SEQ ID 341) | (SEQ ID 342) | (SEQ ID 343) | (SEQ ID 344) |
| CH19_6-G10xI2C6 | (SEQ ID 352) | (SEQ ID 353) | (SEQ ID 354) | (SEQ ID 355) | (SEQ ID 356) | (SEQ ID 357) |
| CH19_4-H8xI2C6 | (SEQ ID 365) | (SEQ ID 366) | (SEQ ID 367) | (SEQ ID 368) | (SEQ ID 369) | (SEQ ID 370) |
| CH19_2-E4xI2C6 | (SEQ ID 378) | (SEQ ID 379) | (SEQ ID 380) | (SEQ ID 381) | (SEQ ID 382) | (SEQ ID 383) |
| CH19_6-B8xI2C6 | (SEQ ID 391) | (SEQ ID 392) | (SEQ ID 393) | (SEQ ID 394) | (SEQ ID 395) | (SEQ ID 396) |
| CH19_0-B4xI2C6 | (SEQ ID 404) | (SEQ ID 405) | (SEQ ID 406) | (SEQ ID 407) | (SEQ ID 408) | (SEQ ID 409) |
| CH19_9-F1xI2C6 | (SEQ ID 417) | (SEQ ID 418) | (SEQ ID 419) | (SEQ ID 420) | (SEQ ID 421) | (SEQ ID 422) |
| CH19_4-A7xI2C6 | (SEQ ID 430) | (SEQ ID 431) | (SEQ ID 432) | (SEQ ID 433) | (SEQ ID 434) | (SEQ ID 435) |
| CH19_6-E12xI2C6 | (SEQ ID 443) | (SEQ ID 444) | (SEQ ID 445) | (SEQ ID 446) | (SEQ ID 447) | (SEQ ID 448) |
| CH19_6-C12xI2C6 | (SEQ ID 456) | (SEQ ID 457) | (SEQ ID 458) | (SEQ ID 459) | (SEQ ID 460) | (SEQ ID 461) |
| CH19_6-A7xI2C6 | (SEQ ID 469) | (SEQ ID 470) | (SEQ ID 471) | (SEQ ID 472) | (SEQ ID 473) | (SEQ ID 474) |
| CH19_6-G8xI2C6 | (SEQ ID 482) | (SEQ ID 483) | (SEQ ID 484) | (SEQ ID 485) | (SEQ ID 486) | (SEQ ID 487) |
| CH19_6-F9xI2C6 | (SEQ ID 495) | (SEQ ID 496) | (SEQ ID 497) | (SEQ ID 498) | (SEQ ID 499) | (SEQ ID 500) |
| CH19_0-C11xI2C6 | (SEQ ID 508) | (SEQ ID 509) | (SEQ ID 510) | (SEQ ID 511) | (SEQ ID 512) | (SEQ ID 513) |
| CH19_8-F6xI2C6 | (SEQ ID 521) | (SEQ ID 522) | (SEQ ID 523) | (SEQ ID 524) | (SEQ ID 525) | (SEQ ID 526) |
| CH19_0-G9xI2C6 | (SEQ ID 534) | (SEQ ID 535) | (SEQ ID 536) | (SEQ ID 537) | (SEQ ID 538) | (SEQ ID 539) |
| CH19_1-E11xI2C6 | (SEQ ID 547) | (SEQ ID 548) | (SEQ ID 549) | (SEQ ID 550) | (SEQ ID 551) | (SEQ ID 552) |
| CH19_0-F5xI2C6 | (SEQ ID 560) | (SEQ ID 561) | (SEQ ID 562) | (SEQ ID 563) | (SEQ ID 564) | (SEQ ID 565) |
| CH19_1-E1xI2C6 | (SEQ ID 573) | (SEQ ID 574) | (SEQ ID 575) | (SEQ ID 576) | (SEQ ID 577) | (SEQ ID 578) |
| CH19_1-E6xI2C6 | (SEQ ID 586) | (SEQ ID 587) | (SEQ ID 588) | (SEQ ID 589) | (SEQ ID 590) | (SEQ ID 591) |
| CH19_2G6_302xI2C6 | (SEQ ID 599) | (SEQ ID 600) | (SEQ ID 601) | (SEQ ID 602) | (SEQ ID 603) | (SEQ ID 604) |

| Ab | LC V-region | HC V-region |
|---|---|---|
| CH19_2G6_302_VKGxI2C6 | (SEQ ID 9) | (SEQ ID 7) |
| | (SEQ ID 10) | (SEQ ID 8) |
| CH19_0-E11xI2C6 | (SEQ ID 22) | (SEQ ID 20) |
| | (SEQ ID 23) | (SEQ ID 21) |
| CH19_5-G4xI2C6 | (SEQ ID 35) | (SEQ ID 33) |
| | (SEQ ID 36) | (SEQ ID 34) |
| CH19_8-H6xI2C6 | (SEQ ID 48) | (SEQ ID 46) |
| | (SEQ ID 49) | (SEQ ID 47) |
| CH19_2-C11xI2C6 | (SEQ ID 61) | (SEQ ID 59) |
| | (SEQ ID 62) | (SEQ ID 60) |
| CH19_2-A10xI2C6 | (SEQ ID 74) | (SEQ ID 72) |
| | (SEQ ID 75) | (SEQ ID 73) |
| CH19_1-D11xI2C6 | (SEQ ID 87) | (SEQ ID 85) |
| | (SEQ ID 88) | (SEQ ID 86) |
| CH19_9-F9xI2C6 | (SEQ ID 100) | (SEQ ID 98) |
| | (SEQ ID 101) | (SEQ ID 99) |
| CH19_1-H8xI2C6 | (SEQ ID 113) | (SEQ ID 111) |
| | (SEQ ID 114) | (SEQ ID 112) |
| CH19_1-B12xI2C6 | (SEQ ID 126) | (SEQ ID 124) |
| | (SEQ ID 127) | (SEQ ID 125) |
| CH19_0-C4xI2C6 | (SEQ ID 139) | (SEQ ID 137) |
| | (SEQ ID 140) | (SEQ ID 138) |
| CH19_3-F2xI2C6 | (SEQ ID 152) | (SEQ ID 150) |
| | (SEQ ID 153) | (SEQ ID 151) |
| CH19_3- | (SEQ ID 165) | (SEQ ID 163) |

-continued

Sequence Table

| | | |
|---|---|---|
| B10xI2C6 | (SEQ ID 166) | (SEQ ID 164) |
| CH19_0-G4xI2C6 | (SEQ ID 178) | (SEQ ID 176) |
| | (SEQ ID 179) | (SEQ ID 177) |
| CH19_0-H5xI2C6 | (SEQ ID 191) | (SEQ ID 189) |
| | (SEQ ID 192) | (SEQ ID 190) |
| CH19_0-B8xI2C6 | (SEQ ID 204) | (SEQ ID 202) |
| | (SEQ ID 205) | (SEQ ID 203) |
| CH19_2-D9xI2C6 | (SEQ ID 217) | (SEQ ID 215) |
| | (SEQ ID 218) | (SEQ ID 216) |
| CH19_8-H7xI2C6 | (SEQ ID 230) | (SEQ ID 228) |
| | (SEQ ID 231) | (SEQ ID 229) |
| CH19_9-C2xI2C6 | (SEQ ID 243) | (SEQ ID 241) |
| | (SEQ ID 244) | (SEQ ID 242) |
| CH19_3-D5xI2C6 | (SEQ ID 256) | (SEQ ID 254) |
| | (SEQ ID 257) | (SEQ ID 255) |
| CH19_1-G11xI2C6 | (SEQ ID 269) | (SEQ ID 267) |
| | (SEQ ID 270) | (SEQ ID 268) |
| CH19_1-H11xI2C6 | (SEQ ID 282) | (SEQ ID 280) |
| | (SEQ ID 283) | (SEQ ID 281) |
| CH19_9-F3xI2C6 | (SEQ ID 295) | (SEQ ID 293) |
| | (SEQ ID 296) | (SEQ ID 294) |
| CH19_2-G6xI2C6 | (SEQ ID 308) | (SEQ ID 306) |
| | (SEQ ID 309) | (SEQ ID 307) |
| CH19_2-H7xI2C6 | (SEQ ID 321) | (SEQ ID 319) |
| | (SEQ ID 322) | (SEQ ID 320) |
| CH19_5-B3xI2C6 | (SEQ ID 334) | (SEQ ID 332) |
| | (SEQ ID 335) | (SEQ ID 333) |
| CH19_5-E10xI2C6 | (SEQ ID 347) | (SEQ ID 345) |
| | (SEQ ID 348) | (SEQ ID 346) |
| CH19_6-G10xI2C6 | (SEQ ID 360) | (SEQ ID 358) |
| | (SEQ ID 361) | (SEQ ID 359) |
| CH19_4-H8xI2C6 | (SEQ ID 373) | (SEQ ID 371) |
| | (SEQ ID 374) | (SEQ ID 372) |
| CH19_2-E4xI2C6 | (SEQ ID 386) | (SEQ ID 384) |
| | (SEQ ID 387) | (SEQ ID 385) |
| CH19_6-B8xI2C6 | (SEQ ID 399) | (SEQ ID 397) |
| | (SEQ ID 400) | (SEQ ID 398) |
| CH19_0-B4xI2C6 | (SEQ ID 412) | (SEQ ID 410) |
| | (SEQ ID 413) | (SEQ ID 411) |
| CH19_9-F1xI2C6 | (SEQ ID 425) | (SEQ ID 423) |
| | (SEQ ID 426) | (SEQ ID 424) |
| CH19_4-A7xI2C6 | (SEQ ID 438) | (SEQ ID 436) |
| | (SEQ ID 439) | (SEQ ID 437) |
| CH19_6-E12xI2C6 | (SEQ ID 451) | (SEQ ID 449) |
| | (SEQ ID 452) | (SEQ ID 450) |
| CH19_6-C12xI2C6 | (SEQ ID 464) | (SEQ ID 462) |
| | (SEQ ID 465) | (SEQ ID 463) |
| CH19_6-A7xI2C6 | (SEQ ID 477) | (SEQ ID 475) |
| | (SEQ ID 478) | (SEQ ID 476) |
| CH19_6-G8xI2C6 | (SEQ ID 490) | (SEQ ID 488) |
| | (SEQ ID 491) | (SEQ ID 489) |
| CH19_6-F9xI2C6 | (SEQ ID 503) | (SEQ ID 501) |
| | (SEQ ID 504) | (SEQ ID 502) |
| CH19_0-C11xI2C6 | (SEQ ID 516) | (SEQ ID 514) |
| | (SEQ ID 517) | (SEQ ID 515) |
| CH19_8-F6xI2C6 | (SEQ ID 529) | (SEQ ID 527) |
| | (SEQ ID 530) | (SEQ ID 528) |
| CH19_0-G9xI2C6 | (SEQ ID 542) | (SEQ ID 540) |
| | (SEQ ID 543) | (SEQ ID 541) |
| CH19_1-E11xI2C6 | (SEQ ID 555) | (SEQ ID 553) |
| | (SEQ ID 556) | (SEQ ID 554) |
| CH19_0-F5xI2C6 | (SEQ ID 568) | (SEQ ID 566) |
| | (SEQ ID 569) | (SEQ ID 567) |
| CH19_1-E1xI2C6 | (SEQ ID 581) | (SEQ ID 579) |
| | (SEQ ID 582) | (SEQ ID 580) |
| CH19_1-E6xI2C6 | (SEQ ID 594) | (SEQ ID 592) |
| | (SEQ ID 595) | (SEQ ID 593) |
| CH19_2G6_302xI2C6 | (SEQ ID 607) | (SEQ ID 605) |
| | (SEQ ID 608) | (SEQ ID 606) |

| Ab | VH-VL |
|---|---|
| CH19_2G6_302_VKGxI2C6 | (SEQ ID 11) |
| | (SEQ ID 12) |

-continued

| Sequence Table | |
|---|---|
| CH19_0-E11xI2C6 | (SEQ ID 24)<br>(SEQ ID 25) |
| CH19_5-G4xI2C6 | (SEQ ID 37)<br>(SEQ ID 38) |
| CH19_8-H6xI2C6 | (SEQ ID 50)<br>(SEQ ID 51) |
| CH19_2-C11xI2C6 | (SEQ ID 63)<br>(SEQ ID 64) |
| CH19_2-A10xI2C6 | (SEQ ID 76)<br>(SEQ ID 77) |
| CH19_1-D11 xI2C6 | (SEQ ID 89)<br>(SEQ ID 90) |
| CH19_9-F9xI2C6 | (SEQ ID 102)<br>(SEQ ID 103) |
| CH19_1-H8xI2C6 | (SEQ ID 115)<br>(SEQ ID 116) |
| CH19_1-B12xI2C6 | (SEQ ID 128)<br>(SEQ ID 129) |
| CH19_0-C4xI2C6 | (SEQ ID 141)<br>(SEQ ID 142) |
| CH19_3-F2xI2C6 | (SEQ ID 154)<br>(SEQ ID 155) |
| CH19_3-B10xI2C6 | (SEQ ID 167)<br>(SEQ ID 168) |
| CH19_0-G4xI2C6 | (SEQ ID 180)<br>(SEQ ID 181) |
| CH19_0-H5xI2C6 | (SEQ ID 193)<br>(SEQ ID 194) |
| CH19_0-B8xI2C6 | (SEQ ID 206)<br>(SEQ ID 207) |
| CH19_2-D9xI2C6 | (SEQ ID 219)<br>(SEQ ID 220) |
| CH19_8-H7xI2C6 | (SEQ ID 232)<br>(SEQ ID 233) |
| CH19_9-C2xI2C6 | (SEQ ID 245)<br>(SEQ ID 246) |
| CH19_3-D5xI2C6 | (SEQ ID 258)<br>(SEQ ID 259) |
| CH19_1-G11xI2C6 | (SEQ ID 271)<br>(SEQ ID 272) |
| CH19_1-H11xI2C6 | (SEQ ID 284)<br>(SEQ ID 285) |
| CH19_9-F3xI2C6 | (SEQ ID 297)<br>(SEQ ID 298) |
| CH19_2-G6xI2C6 | (SEQ ID 310)<br>(SEQ ID 311) |
| CH19_2-H7xI2C6 | (SEQ ID 323)<br>(SEQ ID 324) |
| CH19_5-B3xI2C6 | (SEQ ID 336)<br>(SEQ ID 337) |
| CH19_5-E10xI2C6 | (SEQ ID 349)<br>(SEQ ID 350) |
| CH19_6-G10xI2C6 | (SEQ ID 362)<br>(SEQ ID 363) |
| CH19_4-H8xI2C6 | (SEQ ID 375)<br>(SEQ ID 376) |
| CH19_2-E4xI2C6 | (SEQ ID 388)<br>(SEQ ID 389) |
| CH19_6-B8xI2C6 | (SEQ ID 401)<br>(SEQ ID 402) |
| CH19_0-B4xI2C6 | (SEQ ID 414)<br>(SEQ ID 415) |
| CH19_9-F1xI2C6 | (SEQ ID 427)<br>(SEQ ID 428) |
| CH19_4-A7xI2C6 | (SEQ ID 440)<br>(SEQ ID 441) |
| CH19_6-E12xI2C6 | (SEQ ID 453)<br>(SEQ ID 454) |
| CH19_6-C12xI2C6 | (SEQ ID 466)<br>(SEQ ID 467) |
| CH19_6-A7xI2C6 | (SEQ ID 479)<br>(SEQ ID 480) |
| CH19_6-G8xI2C6 | (SEQ ID 492)<br>(SEQ ID 493) |
| CH19_6-F9xI2C6 | (SEQ ID 505)<br>(SEQ ID 506) |
| CH19_0- | (SEQ ID 518) |

| Sequence Table | |
|---|---|
| C11xI2C6 | (SEQ ID 519) |
| CH19_8-F6xI2C6 | (SEQ ID 531) |
| | (SEQ ID 532) |
| CH19_0-G9xI2C6 | (SEQ ID 544) |
| | (SEQ ID 545) |
| CH19_1-E11xI2C6 | (SEQ ID 557) |
| | (SEQ ID 558) |
| CH19_0-F5xI2C6 | (SEQ ID 570) |
| | (SEQ ID 571) |
| CH19_1-E1xI2C6 | (SEQ ID 583) |
| | (SEQ ID 584) |
| CH19_1-E6xI2C6 | (SEQ ID 596) |
| | (SEQ ID 597) |
| CH19_2G6_302xI2C6 | (SEQ ID 609) |
| | (SEQ ID 610) |

| CDH19 x CD3 | |
|---|---|
| CH19_2G6_302_VKGxI2C6 | (SEQ ID 13) |
| CH19_0-E11xI2C6 | (SEQ ID 26) |
| CH19_5-G4xI2C6 | (SEQ ID 39) |
| CH19_8-H6xI2C6 | (SEQ ID 52) |
| CH19_2-C11xI2C6 | (SEQ ID 65) |
| CH19_2-A10xI2C6 | (SEQ ID 78) |
| CH19_1-D11xI2C6 | (SEQ ID 91) |
| CH19_9-F9xI2C6 | (SEQ ID 104) |
| CH19_1-H8xI2C6 | (SEQ ID 117) |
| CH19_1-B12xI2C6 | (SEQ ID 130) |
| CH19_0-C4xI2C6 | (SEQ ID 143) |
| CH19_3-F2xI2C6 | (SEQ ID 156) |
| CH19_3-B10xI2C6 | (SEQ ID 169) |
| CH19_0-G4xI2C6 | (SEQ ID 182) |
| CH19_0-H5xI2C6 | (SEQ ID 195) |
| CH19_0-B8xI2C6 | (SEQ ID 208) |
| CH19_2-D9xI2C6 | (SEQ ID 221) |
| CH19_8-H7xI2C6 | (SEQ ID 234) |
| CH19_9-C2xI2C6 | (SEQ ID 247) |
| CH19_3-D5xI2C6 | (SEQ ID 260) |
| CH19_1-G11xI2C6 | (SEQ ID 273) |
| CH19_1-H11xI2C6 | (SEQ ID 286) |
| CH19_9-F3xI2C6 | (SEQ ID 299) |
| CH19_2-G6xI2C6 | (SEQ ID 312) |
| CH19_2-H7xI2C6 | (SEQ ID 325) |
| CH19_5-B3xI2C6 | (SEQ ID 338) |
| CH19_5-E10xI2C6 | (SEQ ID 351) |
| CH19_6-G10xI2C6 | (SEQ ID 364) |
| CH19_4-H8xI2C6 | (SEQ ID 377) |
| CH19_2-E4xI2C6 | (SEQ ID 390) |

Sequence Table -continued

| | | |
|---|---|---|
| CH19_6-B8xI2C6 | | (SEQ ID 403) |
| CH19_0-B4xI2C6 | | (SEQ ID 416) |
| CH19_9-F1xI2C6 | | (SEQ ID 429) |
| CH19_4-A7xI2C6 | | (SEQ ID 442) |
| CH19_6-E12xI2C6 | | (SEQ ID 455) |
| CH19_6-C12xI2C6 | | (SEQ ID 468) |
| CH19_6-A7xI2C6 | | (SEQ ID 481) |
| CH19_6-G8xI2C6 | | (SEQ ID 494) |
| CH19_6-F9xI2C6 | | (SEQ ID 507) |
| CH19_0-C11xI2C6 | | (SEQ ID 520) |
| CH19_8-F6xI2C6 | | (SEQ ID 533) |
| CH19_0-G9xI2C6 | | (SEQ ID 546) |
| CH19_1-E11xI2C6 | | (SEQ ID 559) |
| CH19_0-F5xI2C6 | | (SEQ ID 572) |
| CH19_1-E1xI2C6 | | (SEQ ID 585) |
| CH19_1-E6xI2C6 | | (SEQ ID 598) |
| CH19_2G6_302xI2C6 | | (SEQ ID 611) |

| SEQ ID | Designation | |
|---|---|---|
| 1. | CH19_2G6_302_VKGxI2C6-156 | |
| 2. | CH19_0-E11xI2C6-156 | |
| 3. | CH19_5-G4xI2C6-156 | |
| 4. | CH19_8-H6xI2C6-156 | |
| 5. | CH19_2-C11xI2C6-156 | |
| 6. | CH19_2-A10xI2C6-156 | |
| 7. | CH19_1-D11xI2C6-156 | |
| 8. | CH19_9-F9xI2C6-156 | |
| 9. | CH19_1-H8xI2C6-156 | |
| 10. | CH19_1-B12xI2C6-156 | |
| 11. | CH19_0-C4xI2C6-156 | |
| 12. | CH19_3-F2xI2C6-156 | |
| 13. | CH19_3-B10xI2C6-156 | |
| 14. | CH19_0-G4xI2C6-156 | |
| 15. | CH19_0-H5xI2C6-156 | |
| 16. | CH19_0-B8xI2C6-156 | |
| 17. | CH19_2-D9xI2C6-156 | |
| 18. | CH19_8-H7xI2C6-156 | |
| 19. | CH19_9-C2xI2C6-156 | |
| 20. | CH19_3-D5xI2C6-156 | |

| | Sequence Table |
|---|---|
| 21. | CH19_1-G11xI2C6-156 |
| 22. | CH19_1-H11xI2C6-156 |
| 23. | CH19_9-F3xI2C6-156 |
| 24. | CH19_2-G6xI2C6-156 |
| 25. | CH19_2-H7xI2C6-156 |
| 26. | CH19_5-B3xI2C6-156 |
| 27. | CH19_5-E10xI2C6-156 |
| 28. | CH19_6-G10xI2C6-156 |
| 29. | CH19_4-H8xI2C6-156 |
| 30. | CH19_2-E4xI2C6-156 |
| 31. | CH19_6-B8xI2C6-156 |
| 32. | CH19_0-B4xI2C6-156 |
| 33. | CH19_9-F1xI2C6-156 |
| 34. | CH19_4-A7xI2C6-156 |
| 35. | CH19_6-E12xI2C6-156 |
| 36. | CH19_6-C12xI2C6-156 |
| 37. | CH19_6-A7xI2C6-156 |
| 38. | CH19_6-G8xI2C6-156 |
| 39. | CH19_6-F9xI2C6-156 |
| 40. | CH19_0-C11xI2C6-156 |
| 41. | CH19_8-F6xI2C6-156 |
| 42. | CH19_0-G9xI2C6-156 |
| 43. | CH19_1-E11xI2C6-156 |
| 44. | CH19_0-F5xI2C6-156 |
| 45. | CH19_1-E1xI2C6-156 |
| 46. | CH19_1-E6xI2C6-156 |
| 47. | CH19_2G6_302xI2C6-156 |
| 48. | CH19_2G6_302_VKGxI2C6-LFcBY |
| 49. | CH19_0-E11xI2C6-LFcBY |
| 50. | CH19_5-G4xI2C6-LFcBY |
| 51. | CH19_8-H6xI2C6-LFcBY |
| 52. | CH19_2-C11xI2C6-LFcBY |
| 53. | CH19_2-A10xI2C6-LFcBY |
| 54. | CH19_1-D11xI2C6-LFcBY |
| 55. | CH19_9-F9xI2C6-LFcBY |
| 56. | CH19_1-H8xI2C6-LFcBY |
| 57. | CH19_1-B12xI2C6-LFcBY |
| 58. | CH19_0-C4xI2C6-LFcBY |

-continued

| | Sequence Table |
|---|---|
| 59. | CH19__3-F2xI2C6-LFcBY |
| 60. | CH19__3-B10xI2C6-LFcBY |
| 61. | CH19__0-G4xI2C6-LFcBY |
| 62. | CH19__0-H5xI2C6-LFcBY |
| 63. | CH19__0-B8xI2C6-LFcBY |
| 64. | CH19__2-D9xI2C6-LFcBY |
| 65. | CH19__8-H7xI2C6-LFcBY |
| 66. | CH19__9-C2xI2C6-LFcBY |
| 67. | CH19__3-D5xI2C6-LFcBY |
| 68. | CH19__1-G11xI2C6-LFcBY |
| 69. | CH19__1-H11xI2C6-LFcBY |
| 70. | CH19__9-F3xI2C6-LFcBY |
| 71. | CH19__2-G6xI2C6-LFcBY |
| 72. | CH19__2-H7xI2C6-LFcBY |
| 73. | CH19__5-B3xI2C6-LFcBY |
| 74. | CH19__5-E10xI2C6-LFcBY |
| 75. | CH19__6-G10xI2C6-LFcBY |
| 76. | CH19__4-H8xI2C6-LFcBY |
| 77. | CH19__2-E4xI2C6-LFcBY |
| 78. | CH19__6-B8xI2C6-LFcBY |
| 79. | CH19__0-B4xI2C6-LFcBY |
| 80. | CH19__9-F1xI2C6-LFcBY |
| 81. | CH19__4-A7xI2C6-LFcBY |
| 82. | CH19__6-E12xI2C6-LFcBY |
| 83. | CH19__6-C12xI2C6-LFcBY |
| 84. | CH19__6-A7xI2C6-LFcBY |
| 85. | CH19__6-G8xI2C6-LFcBY |
| 86. | CH19__6-F9xI2C6-LFcBY |
| 87. | CH19__0-C11xI2C6-LFcBY |
| 88. | CH19__8-F6xI2C6-LFcBY |
| 89. | CH19__0-G9xI2C6-LFcBY |
| 90. | CH19__1-E11xI2C6-LFcBY |
| 91. | CH19__0-F5xI2C6-LFcBY |
| 92. | CH19__1-E1xI2C6-LFcBY |
| 93. | CH19__1-E6xI2C6-LFcBY |
| 94. | CH19__2G6__302xI2C6-LFcBY |
| 95. | CH19__2G6__302__VKGxI2C6-LFcBY-156 |

| | Sequence Table | |
|---|---|---|
| 96. | CH19_0-E11xI2C6-LFcBY-156 | |
| 97. | CH19_5-G4xI2C6-LFcBY-156 | |
| 98. | CH19_8-H6xI2C6-LFcBY-156 | |
| 99. | CH19_2-C11xI2C6-LFcBY-156 | |
| 100. | CH19_2-A10xI2C6-LFcBY-156 | |
| 101. | CH19_1-D11xI2C6-LFcBY-156 | |
| 102. | CH19_9-F9xI2C6-LFcBY-156 | |
| 103. | CH19_1-H8xI2C6-LFcBY-156 | |
| 104. | CH19_1-B12xI2C6-LFcBY-156 | |
| 105. | CH19_0-C4xI2C6-LFcBY-156 | |
| 106. | CH19_3-F2xI2C6-LFcBY-156 | |
| 107. | CH19_3-B10xI2C6-LFcBY-156 | |
| 108. | CH19_0-G4xI2C6-LFcBY-156 | |
| 109. | CH19_0-H5xI2C6-LFcBY-156 | |
| 110. | CH19_0-B8xI2C6-LFcBY-156 | |
| 111. | CH19_2-D9xI2C6-LFcBY-156 | |
| 112. | CH19_8-H7xI2C6-LFcBY-156 | |
| 113. | CH19_9-C2xI2C6-LFcBY-156 | |
| 114. | CH19_3-D5xI2C6-LFcBY-156 | |
| 115. | CH19_1-G11xI2C6-LFcBY-156 | |
| 116. | CH19_1-H11xI2C6-LFcBY-156 | |
| 117. | CH19_9-F3xI2C6-LFcBY-156 | |
| 118. | CH19_2-G6xI2C6-LFcBY-156 | |
| 119. | CH19_2-H7xI2C6-LFcBY-156 | |
| 120. | CH19_5-B3xI2C6-LFcBY-156 | |
| 121. | CH19_5-E10xI2C6-LFcBY-156 | |
| 122. | CH19_6-G10xI2C6-LFcBY-156 | |
| 123. | CH19_4-H8xI2C6-LFcBY-156 | |
| 124. | CH19_2-E4xI2C6-LFcBY-156 | |
| 125. | CH19_6-B8xI2C6-LFcBY-156 | |
| 126. | CH19_0-B4xI2C6-LFcBY-156 | |
| 127. | CH19_9-F1xI2C6-LFcBY-156 | |
| 128. | CH19_4-A7xI2C6-LFcBY-156 | |

-continued

| | Sequence Table |
|---|---|
| 129. | CH19__6-E12xI2C6-LFcBY-156 |
| 130. | CH19__6-C12xI2C6-LFcBY-156 |
| 131. | CH19__6-A7xI2C6-LFcBY-156 |
| 132. | CH19__6-G8xI2C6-LFcBY-156 |
| 133. | CH19__6-F9xI2C6-LFcBY-156 |
| 134. | CH19__0-C11xI2C6-LFcBY-156 |
| 135. | CH19__8-F6xI2C6-LFcBY-156 |
| 136. | CH19__0-G9xI2C6-LFcBY-156 |
| 137. | CH19__1-E11xI2C6-LFcBY-156 |
| 138. | CH19__0-F5xI2C6-LFcBY-156 |
| 139. | CH19__1-E1xI2C6-LFcBY-156 |
| 140. | CH19__1-E6xI2C6-LFcBY-156 |
| 141. | CH19__2G6__302xI2C6-LFcBY-156 |
| 142. | CH19__2G6__302__VKGxI2C6-Cys-Loop |
| 143. | CH19__0-E11xI2C6-Cys-Loop |
| 144. | CH19__5-G4xI2C6-Cys-Loop |
| 145. | CH19__8-H6xI2C6-Cys-Loop |
| 146. | CH19__2-C11xI2C6-Cys-Loop |
| 147. | CH19__2-A10xI2C6-Cys-Loop |
| 148. | CH19__1-D11xI2C6-Cys-Loop |
| 149. | CH19__9-F9xI2C6-Cys-Loop |
| 150. | CH19__1-H8xI2C6-Cys-Loop |
| 151. | CH19__1-B12xI2C6-Cys-Loop |
| 152. | CH19__0-C4xI2C6-Cys-Loop |
| 153. | CH19__3-F2xI2C6-Cys-Loop |
| 154. | CH19__3-B10xI2C6-Cys-Loop |
| 155. | CH19__0-G4xI2C6-Cys-Loop |
| 156. | CH19__0-H5xI2C6-Cys-Loop |
| 157. | CH19__0-B8xI2C6-Cys-Loop |
| 158. | CH19__2-D9xI2C6-Cys-Loop |
| 159. | CH19__8-H7xI2C6-Cys-Loop |
| 160. | CH19__9-C2xI2C6-Cys-Loop |
| 161. | CH19__3-D5xI2C6-Cys-Loop |

-continued

| | Sequence Table | |
|---|---|---|
| 162. | CH19_1-G11xI2C6-Cys-Loop | |
| 163. | CH19_1-H11xI2C6-Cys-Loop | |
| 164. | CH19_9-F3xI2C6-Cys-Loop | |
| 165. | CH19_2-G6xI2C6-Cys-Loop | |
| 166. | CH19_2-H7xI2C6-Cys-Loop | |
| 167. | CH19_5-B3xI2C6-Cys-Loop | |
| 168. | CH19_5-E10xI2C6-Cys-Loop | |
| 169. | CH19_6-G10xI2C6-Cys-Loop | |
| 170. | CH19_4-H8xI2C6-Cys-Loop | |
| 171. | CH19_2-E4xI2C6-Cys-Loop | |
| 172. | CH19_6-B8xI2C6-Cys-Loop | |
| 173. | CH19_0-B4xI2C6-Cys-Loop | |
| 174. | CH19_9-F1xI2C6-Cys-Loop | |
| 175. | CH19_4-A7xI2C6-Cys-Loop | |
| 176. | CH19_6-E12xI2C6-Cys-Loop | |
| 177. | CH19_6-C12xI2C6-Cys-Loop | |
| 178. | CH19_6-A7xI2C6-Cys-Loop | |
| 179. | CH19_6-G8xI2C6-Cys-Loop | |
| 180. | CH19_6-F9xI2C6-Cys-Loop | |
| 181. | CH19_0-C11xI2C6-Cys-Loop | |
| 182. | CH19_8-F6xI2C6-Cys-Loop | |
| 183. | CH19_0-G9xI2C6-Cys-Loop | |
| 184. | CH19_1-E11xI2C6-Cys-Loop | |
| 185. | CH19_0-F5xI2C6-Cys-Loop | |
| 186. | CH19_1-E1xI2C6-Cys-Loop | |
| 187. | CH19_1-E6xI2C6-Cys-Loop | |
| 188. | CH19_2G6_302xI2C6-Cys-Loop | |
| 189. | CH19_2G6_302_VKGxI2C6-LH-FcB-CH | |
| 190. | CH19_0-E11xI2C6-LH-FcB-CH | |
| 191. | CH19_5-G4xI2C6-LH-FcB-CH | |
| 192. | CH19_8-H6xI2C6-LH-FcB-CH | |
| 193. | CH19_2-C11xI2C6-LH-FcB-CH | |

Sequence Table (continued)

| | |
|---|---|
| 194. | CH19_2-A10xI2C6-LH-FcB-CH |
| 195. | CH19_1-D11xI2C6-LH-FcB-CH |
| 196. | CH19_9-F9xI2C6-LH-FcB-CH |
| 197. | CH19_1-H8xI2C6-LH-FcB-CH |
| 198. | CH19_1-B12xI2C6-LH-FcB-CH |
| 199. | CH19_0-C4xI2C6-LH-FcB-CH |
| 200. | CH19_3-F2xI2C6-LH-FcB-CH |
| 201. | CH19_3-B10xI2C6-LH-FcB-CH |
| 202. | CH19_0-G4xI2C6-LH-FcB-CH |
| 203. | CH19_0-H5xI2C6-LH-FcB-CH |
| 204. | CH19_0-B8xI2C6-LH-FcB-CH |
| 205. | CH19_2-D9xI2C6-LH-FcB-CH |
| 206. | CH19_8-H7xI2C6-LH-FcB-CH |
| 207. | CH19_9-C2xI2C6-LH-FcB-CH |
| 208. | CH19_3-D5xI2C6-LH-FcB-CH |
| 209. | CH19_1-G11xI2C6-LH-FcB-CH |
| 210. | CH19_1-H11xI2C6-LH-FcB-CH |
| 211. | CH19_9-F3xI2C6-LH-FcB-CH |
| 212. | CH19_2-G6xI2C6-LH-FcB-CH |
| 213. | CH19_2-H7xI2C6-LH-FcB-CH |
| 214. | CH19_5-B3xI2C6-LH-FcB-CH |
| 215. | CH19_5-E10xI2C6-LH-FcB-CH |
| 216. | CH19_6-G10xI2C6-LH-FcB-CH |
| 217. | CH19_4-H8xI2C6-LH-FcB-CH |
| 218. | CH19_2-E4xI2C6-LH-FcB-CH |
| 219. | CH19_6-B8xI2C6-LH-FcB-CH |
| 220. | CH19_0-B4xI2C6-LH-FcB-CH |
| 221. | CH19_9-F1xI2C6-LH-FcB-CH |
| 222. | CH19_4-A7xI2C6-LH-FcB-CH |
| 223. | CH19_6-E12xI2C6-LH-FcB-CH |
| 224. | CH19_6-C12xI2C6-LH-FcB-CH |
| 225. | CH19_6-A7xI2C6-LH-FcB-CH |
| 226. | CH19_6-G8xI2C6-LH-FcB-CH |

| | Sequence Table |
|---|---|
| 227. | CH19_6-F9xI2C6-LH-FcB-CH |
| 228. | CH19_0-C11xI2C6-LH-FcB-CH |
| 229. | CH19_8-F6xI2C6-LH-FcB-CH |
| 230. | CH19_0-G9xI2C6-LH-FcB-CH |
| 231. | CH19_1-E11xI2C6-LH-FcB-CH |
| 232. | CH19_0-F5xI2C6-LH-FcB-CH |
| 233. | CH19_1-E1xI2C6-LH-FcB-CH |
| 234. | CH19_1-E6xI2C6-LH-FcB-CH |
| 235. | CH19_2G6_302xI2C6-LH-FcB-CH |
| 236. | CH19_2G6_302_VKGxI2C6-LH-FcB-LH |
| 237. | CH19_0-E11xI2C6-LH-FcB-LH |
| 238. | CH19_5-G4xI2C6-LH-FcB-LH |
| 239. | CH19_8-H6xI2C6-LH-FcB-LH |
| 240. | CH19_2-C11xI2C6-LH-FcB-LH |
| 241. | CH19_2-A10xI2C6-LH-FcB-LH |
| 242. | CH19_1-D11xI2C6-LH-FcB-LH |
| 243. | CH19_9-F9xI2C6-LH-FcB-LH |
| 244. | CH19_1-H8xI2C6-LH-FcB-LH |
| 245. | CH19_1-B12xI2C6-LH-FcB-LH |
| 246. | CH19_0-C4xI2C6-LH-FcB-LH |
| 247. | CH19_3-F2xI2C6-LH-FcB-LH |
| 248. | CH19_3-B10xI2C6-LH-FcB-LH |
| 249. | CH19_0-G4xI2C6-LH-FcB-LH |
| 250. | CH19_0-H5xI2C6-LH-FcB-LH |
| 251. | CH19_0-B8xI2C6-LH-FcB-LH |
| 252. | CH19_2-D9xI2C6-LH-FcB-LH |
| 253. | CH19_8-H7xI2C6-LH-FcB-LH |
| 254. | CH19_9-C2xI2C6-LH-FcB-LH |
| 255. | CH19_3-D5xI2C6-LH-FcB-LH |
| 256. | CH19_1-G11xI2C6-LH-FcB-LH |
| 257. | CH19_1-H11xI2C6-LH-FcB-LH |
| 258. | CH19_9-F3xI2C6-LH-FcB-LH |
| 259. | CH19_2-G6xI2C6-LH-FcB-LH |

-continued

| | Sequence Table |
|---|---|
| 260. | CH19_2-H7xI2C6-LH-FcB-LH |
| 261. | CH19_5-B3xI2C6-LH-FcB-LH |
| 262. | CH19_5-E10xI2C6-LH-FcB-LH |
| 263. | CH19_6-G10xI2C6-LH-FcB-LH |
| 264. | CH19_4-H8xI2C6-LH-FcB-LH |
| 265. | CH19_2-E4xI2C6-LH-FcB-LH |
| 266. | CH19_6-B8xI2C6-LH-FcB-LH |
| 267. | CH19_0-B4xI2C6-LH-FcB-LH |
| 268. | CH19_9-F1xI2C6-LH-FcB-LH |
| 269. | CH19_4-A7xI2C6-LH-FcB-LH |
| 270. | CH19_6-E12xI2C6-LH-FcB-LH |
| 271. | CH19_6-C12xI2C6-LH-FcB-LH |
| 272. | CH19_6-A7xI2C6-LH-FcB-LH |
| 273. | CH19_6-G8xI2C6-LH-FcB-LH |
| 274. | CH19_6-F9xI2C6-LH-FcB-LH |
| 275. | CH19_0-C11xI2C6-LH-FcB-LH |
| 276. | CH19_8-F6xI2C6-LH-FcB-LH |
| 277. | CH19_0-G9xI2C6-LH-FcB-LH |
| 278. | CH19_1-E11xI2C6-LH-FcB-LH |
| 279. | CH19_0-F5xI2C6-LH-FcB-LH |
| 280. | CH19_1-E1xI2C6-LH-FcB-LH |
| 281. | CH19_1-E6xI2C6-LH-FcB-LH |
| 282. | CH19_2G6_302xI2C6-LH-FcB-LH |
| 283. | CH19_2G6_302_VKGxI2C6-LY-FcB-LH |
| 284. | CH19_0-E11xI2C6-LY-FcB-LH |
| 285. | CH19_5-G4xI2C6-LY-FcB-LH |
| 286. | CH198-H6xI2C6-LY-FcB-LH |
| 287. | CH19_2-C11xI2C6-LY-FcB-LH |
| 288. | CH19_2-A10xI2C6-LY-FcB-LH |
| 289. | CH19_1-D11xI2C6-LY-FcB-LH |
| 290. | CH19_9-F9xI2C6-LY-FcB-LH |
| 291. | CH19_1-H8xI2C6-LY-FcB-LH |

| | Sequence Table |
|---|---|
| 292. | CH19_1-B12xI2C6-LY-FcB-LH |
| 293. | CH19_0-C4xI2C6-LY-FcB-LH |
| 294. | CH19_3-F2xI2C6-LY-FcB-LH |
| 295. | CH19_3-B10xI2C6-LY-FcB-LH |
| 296. | CH19_0-G4xI2C6-LY-FcB-LH |
| 297. | CH19_0-H5xI2C6-LY-FcB-LH |
| 298. | CH19_0-B8xI2C6-LY-FcB-LH |
| 299. | CH19_2-D9xI2C6-LY-FcB-LH |
| 300. | CH19_8-H7xI2C6-LY-FcB-LH |
| 301. | CH19_9-C2xI2C6-LY-FcB-LH |
| 302. | CH19_3-D5xI2C6-LY-FcB-LH |
| 303. | CH19_1-G11xI2C6-LY-FcB-LH |
| 304. | CH19_1-H11xI2C6-LY-FcB-LH |
| 305. | CH19_9-F3xI2C6-LY-FcB-LH |
| 306. | CH19_2-G6xI2C6-LY-FcB-LH |
| 307. | CH19_2-H7xI2C6-LY-FcB-LH |
| 308. | CH19_5-B3xI2C6-LY-FcB-LH |
| 309. | CH19_5-E10xI2C6-LY-FcB-LH |
| 310. | CH19_6-G10xI2C6-LY-FcB-LH |
| 311. | CH19_4-H8xI2C6-LY-FcB-LH |
| 312. | CH19_2-E4xI2C6-LY-FcB-LH |
| 313. | CH19_6-B8xI2C6-LY-FcB-LH |
| 314. | CH19_0-B4xI2C6-LY-FcB-LH |
| 315. | CH19_9-F1xI2C6-LY-FcB-LH |
| 316. | CH19_4-A7xI2C6-LY-FcB-LH |
| 317. | CH19_6-E12xI2C6-LY-FcB-LH |
| 318. | CH19_6-C12xI2C6-LY-FcB-LH |
| 319. | CH19_6-A7xI2C6-LY-FcB-LH |
| 320. | CH19_6-G8xI2C6-LY-FcB-LH |
| 321. | CH19_6-F9xI2C6-LY-FcB-LH |
| 322. | CH19_0-C11xI2C6-LY-FcB-LH |
| 323. | CH19_8-F6xI2C6-LY-FcB-LH |
| 324. | CH19_0-G9xI2C6-LY-FcB-LH |

| | Sequence Table |
|---|---|
| 325. | CH19__1-E11xI2C6-LY-FcB-LH |
| 326. | CH19__0-F5xI2C6-LY-FcB-LH |
| 327. | CH19__1-E1xI2C6-LY-FcB-LH |
| 328. | CH19__1-E6xI2C6-LY-FcB-LH |
| 329. | CH19__2G6__302xI2C6-LY-FcB-LH |
| 330. | CH19__2G6__302__VKGxI2C6-LH-FcB-CH-156 |
| 331. | CH19__0-E11xI2C6-LH-FcB-CH-156 |
| 332. | CH19__5-G4xI2C6-LH-FcB-CH-156 |
| 333. | CH19__8-H6xI2C6-LH-FcB-CH-156 |
| 334. | CH19__2-C11xI2C6-LH-FcB-CH-156 |
| 335. | CH19__2-A10xI2C6-LH-FcB-CH-156 |
| 336. | CH19__1-D11xI2C6-LH-FcB-CH-156 |
| 337. | CH19__9-F9xI2C6-LH-FcB-CH-156 |
| 338. | CH19__1-H8xI2C6-LH-FcB-CH-156 |
| 339. | CH19__1-B12xI2C6-LH-FcB-CH-156 |
| 340. | CH19__0-C4xI2C6-LH-FcB-CH-156 |
| 341. | CH19__3-F2xI2C6-LH-FcB-CH-156 |
| 342. | CH19__3-B10xI2C6-LH-FcB-CH-156 |
| 343. | CH19__0-G4xI2C6-LH-FcB-CH-156 |
| 344. | CH19__0-H5xI2C6-LH-FcB-CH-156 |
| 345. | CH19__0-B8xI2C6-LH-FcB-CH-156 |
| 346. | CH19__2-D9xI2C6-LH-FcB-CH-156 |
| 347. | CH19__8-H7xI2C6-LH-FcB-CH-156 |
| 348. | CH19__9-C2xI2C6-LH-FcB-CH-156 |
| 349. | CH19__3-D5xI2C6-LH-FcB-CH-156 |
| 350. | CH19__1-G11xI2C6-LH-FcB-CH-156 |
| 351. | CH19__1-H11xI2C6-LH-FcB-CH-156 |
| 352. | CH19__9-F3xI2C6-LH-FcB-CH-156 |
| 353. | CH19__2-G6xI2C6-LH-FcB-CH-156 |
| 354. | CH19__2-H7xI2C6-LH-FcB-CH-156 |
| 355. | CH19__5-B3xI2C6-LH-FcB-CH-156 |
| 356. | CH19__5-E10xI2C6-LH-FcB-CH-156 |

| | Sequence Table |
|---|---|
| 357. | CH19_6-G10xI2C6-LH-FcB-CH-156 |
| 358. | CH19_4-H8xI2C6-LH-FcB-CH-156 |
| 359. | CH19_2-E4xI2C6-LH-FcB-CH-156 |
| 360. | CH19_6-B8xI2C6-LH-FcB-CH-156 |
| 361. | CH19_0-B4xI2C6-LH-FcB-CH-156 |
| 362. | CH19_9-F1xI2C6-LH-FcB-CH-156 |
| 363. | CH19_4-A7xI2C6-LH-FcB-CH-156 |
| 364. | CH19_6-E12xI2C6-LH-FcB-CH-156 |
| 365. | CH19_6-C12xI2C6-LH-FcB-CH-156 |
| 366. | CH19_6-A7xI2C6-LH-FcB-CH-156 |
| 367. | CH19_6-G8xI2C6-LH-FcB-CH-156 |
| 368. | CH19_6-F9xI2C6-LH-FcB-CH-156 |
| 369. | CH19_0-C11xI2C6-LH-FcB-CH-156 |
| 370. | CH19_8-F6xI2C6-LH-FcB-CH-156 |
| 371. | CH19_0-G9xI2C6-LH-FcB-CH-156 |
| 372. | CH19_1-E11xI2C6-LH-FcB-CH-156 |
| 373. | CH19_0-F5xI2C6-LH-FcB-CH-156 |
| 374. | CH19_1-E1xI2C6-LH-FcB-CH-156 |
| 375. | CH19_1-E6xI2C6-LH-FcB-CH-156 |
| 376. | CH19_2G6_302xI2C6-LH-FcB-CH-156 |
| 377. | CH19_2G6_302_VKGxI2C6-LH-FcB-LH-156 |
| 378. | CH19_0-E11xI2C6-LH-FcB-LH-156 |
| 379. | CH19_5-G4xI2C6-LH-FcB-LH-156 |
| 380. | CH19_8-H6xI2C6-LH-FcB-LH-156 |
| 381. | CH19_2-C11xI2C6-LH-FcB-LH-156 |
| 382. | CH19_2-A10xI2C6-LH-FcB-LH-156 |
| 383. | CH19_1-D11xI2C6-LH-FcB-LH-156 |
| 384. | CH19_9-F9xI2C6-LH-FcB-LH-156 |
| 385. | CH19_1-H8xI2C6-LH-FcB-LH-156 |
| 386. | CH19_1-B12xI2C6-LH-FcB-LH-156 |
| 387. | CH19_0-C4xI2C6-LH-FcB-LH-156 |
| 388. | CH19_3-F2xI2C6-LH-FcB-LH-156 |

-continued

| | Sequence Table |
|---|---|
| 389. | CH19_3-B10xI2C6-LH-FcB-LH-156 |
| 390. | CH19_0-G4xI2C6-LH-FcB-LH-156 |
| 391. | CH19_0-H5xI2C6-LH-FcB-LH-156 |
| 392. | CH19_0-B8xI2C6-LH-FcB-LH-156 |
| 393. | CH19_2-D9xI2C6-LH-FcB-LH-156 |
| 394. | CH19_8-H7xI2C6-LH-FcB-LH-156 |
| 395. | CH19_9-C2xI2C6-LH-FcB-LH-156 |
| 396. | CH19_3-D5xI2C6-LH-FcB-LH-156 |
| 397. | CH19_1-G11xI2C6-LH-FcB-LH-156 |
| 398. | CH19_1-H11xI2C6-LH-FcB-LH-156 |
| 399. | CH19_9-F3xI2C6-LH-FcB-LH-156 |
| 400. | CH19_2-G6xI2C6-LH-FcB-LH-156 |
| 401. | CH19_2-H7xI2C6-LH-FcB-LH-156 |
| 402. | CH19_5-B3xI2C6-LH-FcB-LH-156 |
| 403. | CH19_5-E10xI2C6-LH-FcB-LH-156 |
| 404. | CH19_6-G10xI2C6-LH-FcB-LH-156 |
| 405. | CH19_4-H8xI2C6-LH-FcB-LH-156 |
| 406. | CH19_2-E4xI2C6-LH-FcB-LH-156 |
| 407. | CH19_6-B8xI2C6-LH-FcB-LH-156 |
| 408. | CH19_0-B4xI2C6-LH-FcB-LH-156 |
| 409. | CH19_9-F1xI2C6-LH-FcB-LH-156 |
| 410. | CH19_4-A7xI2C6-LH-FcB-LH-156 |
| 411. | CH19_6-E12xI2C6-LH-FcB-LH-156 |
| 412. | CH19_6-C12xI2C6-LH-FcB-LH-156 |
| 413. | CH19_6-A7xI2C6-LH-FcB-LH-156 |
| 414. | CH19_6-G8xI2C6-LH-FcB-LH-156 |
| 415. | CH19_6-F9xI2C6-LH-FcB-LH-156 |
| 416. | CH19_0-C11xI2C6-LH-FcB-LH-156 |
| 417. | CH19_8-F6xI2C6-LH-FcB-LH-156 |
| 418. | CH19_0-G9xI2C6-LH-FcB-LH-156 |
| 419. | CH19_1-E11xI2C6-LH-FcB-LH-156 |
| 420. | CH19_0-F5xI2C6-LH-FcB-LH-156 |
| 421. | CH19_1-E1xI2C6-LH-FcB-LH-156 |
| 422. | CH19_1-E6xI2C6-LH-FcB-LH-156 |

| | Sequence Table |
|---|---|
| 423. | CH19__2G6__302xI2C6-LH-FcB-LH-156 |
| 424. | CH19__2G6__302__VKGxI2C6-LY-FcB-LH-156 |
| 425. | CH19__0-E11xI2C6-LY-FcB-LH-156 |
| 426. | CH19__5-G4xI2C6-LY-FcB-LH-156 |
| 427. | CH19__8-H6xI2C6-LY-FcB-LH-156 |
| 428. | CH19__2-C11xI2C6-LY-FcB-LH-156 |
| 429. | CH19__2-A10xI2C6-LY-FcB-LH-156 |
| 430. | CH19__1-D11xI2C6-LY-FcB-LH-156 |
| 431. | CH19__9-F9xI2C6-LY-FcB-LH-156 |
| 432. | CH19__1-H8xI2C6-LY-FcB-LH-156 |
| 433. | CH19__1-B12xI2C6-LY-FcB-LH-156 |
| 434. | CH19__0-C4xI2C6-LY-FcB-LH-156 |
| 435. | CH19__3-F2xI2C6-LY-FcB-LH-156 |
| 436. | CH19__3-B10xI2C6-LY-FcB-LH-156 |
| 437. | CH19__0-G4xI2C6-LY-FcB-LH-156 |
| 438. | CH19__0-H5xI2C6-LY-FcB-LH-156 |
| 439. | CH19__0-B8xI2C6-LY-FcB-LH-156 |
| 440. | CH19__2-D9xI2C6-LY-FcB-LH-156 |
| 441. | CH19__8-H7xI2C6-LY-FcB-LH-156 |
| 442. | CH19__9-C2xI2C6-LY-FcB-LH-156 |
| 443. | CH19__3-D5xI2C6-LY-FcB-LH-156 |
| 444. | CH19__1-G11xI2C6-LY-FcB-LH-156 |
| 445. | CH19__1-H11xI2C6-LY-FcB-LH-156 |
| 446. | CH19__9-F3xI2C6-LY-FcB-LH-156 |
| 447. | CH19__2-G6xI2C6-LY-FcB-LH-156 |
| 448. | CH19__2-H7xI2C6-LY-FcB-LH-156 |
| 449. | CH19__5-B3xI2C6-LY-FcB-LH-156 |
| 450. | CH19__5-E10xI2C6-LY-FcB-LH-156 |
| 451. | CH19__6-G10xI2C6-LY-FcB-LH-156 |
| 452. | CH19__4-H8xI2C6-LY-FcB-LH-156 |
| 453. | CH19__2-E4xI2C6-LY-FcB-LH-156 |
| 454. | CH19__6-B8xI2C6-LY-FcB-LH-156 |

| | Sequence Table |
|---|---|
| 455. | CH19__0-B4xI2C6-LY-FcB-LH-156 |
| 456. | CH19__9-F1xI2C6-LY-FcB-LH-156 |
| 457. | CH19__4-A7xI2C6-LY-FcB-LH-156 |
| 458. | CH19__6-E12xI2C6-LY-FcB-LH-156 |
| 459. | CH19__6-C12xI2C6-LY-FcB-LH-156 |
| 460. | CH19__6-A7xI2C6-LY-FcB-LH-156 |
| 461. | CH19__6-G8xI2C6-LY-FcB-LH-156 |
| 462. | CH19__6-F9xI2C6-LY-FcB-LH-156 |
| 463. | CH19__0-C11xI2C6-LY-FcB-LH-156 |
| 464. | CH19__8-F6xI2C6-LY-FcB-LH-156 |
| 465. | CH19__0-G9xI2C6-LY-FcB-LH-156 |
| 466. | CH19__1-E11xI2C6-LY-FcB-LH-156 |
| 467. | CH19__0-F5xI2C6-LY-FcB-LH-156 |
| 468. | CH19__1-E1xI2C6-LY-FcB-LH-156 |
| 469. | CH19__1-E6xI2C6-LY-FcB-LH-156 |
| 470. | CH19__2G6__302xI2C6-LY-FcB-LH-156 |
| 471. | CH19__2G6__302__VKGxI2C6-ALB8 |
| 472. | CH19__0-E11xI2C6-ALB8 |
| 473. | CH19__5-G4xI2C6-ALB8 |
| 474. | CH19__8-H6xI2C6-ALB8 |
| 475. | CH19__2-C11xI2C6-ALB8 |
| 476. | CH19__2-A10xI2C6-ALB8 |
| 477. | CH19__1-D11xI2C6-ALB8 |
| 478. | CH19__9-F9xI2C6-ALB8 |
| 479. | CH19__1-H8xI2C6-ALB8 |
| 480. | CH19__1-B12xI2C6-ALB8 |
| 481. | CH19__0-C4xI2C6-ALB8 |
| 482. | CH19__3-F2xI2C6-ALB8 |
| 483. | CH19__3-B10xI2C6-ALB8 |
| 484. | CH19__0-G4xI2C6-ALB8 |
| 485. | CH19__0-H5xI2C6-ALB8 |
| 486. | CH19__0-B8xI2C6-ALB8 |
| 487. | CH19__2-D9xI2C6-ALB8 |
| 488. | CH19__8-H7xI2C6-ALB8 |
| 489. | CH19__9-C2xI2C6-ALB8 |
| 490. | CH19__3-D5xI2C6-ALB8 |

-continued

| | Sequence Table |
|---|---|
| 491. | CH19_1-G11xI2C6-ALB8 |
| 492. | CH19_1-H11xI2C6-ALB8 |
| 493. | CH19_9-F3xI2C6-ALB8 |
| 494. | CH19_2-G6xI2C6-ALB8 |
| 495. | CH19_2-H7xI2C6-ALB8 |
| 496. | CH19_5-B3xI2C6-ALB8 |
| 497. | CH19_5-E10xI2C6-ALB8 |
| 498. | CH19_6-G10xI2C6-ALB8 |
| 499. | CH19_4-H8xI2C6-ALB8 |
| 500. | CH19_2-E4xI2C6-ALB8 |
| 501. | CH19_6-B8xI2C6-ALB8 |
| 502. | CH19_0-B4xI2C6-ALB8 |
| 503. | CH19_9-F1xI2C6-ALB8 |
| 504. | CH19_4-A7xI2C6-ALB8 |
| 505. | CH19_6-E12xI2C6-ALB8 |
| 506. | CH19_6-C12xI2C6-ALB8 |
| 507. | CH19_6-A7xI2C6-ALB8 |
| 508. | CH19_6-G8xI2C6-ALB8 |
| 509. | CH19_6-F9xI2C6-ALB8 |
| 510. | CH19_0-C11xI2C6-ALB8 |
| 511. | CH19_8-F6xI2C6-ALB8 |
| 512. | CH19_0-G9xI2C6-ALB8 |
| 513. | CH19_1-E11xI2C6-ALB8 |
| 514. | CH19_0-F5xI2C6-ALB8 |
| 515. | CH19_1-E1xI2C6-ALB8 |
| 516. | CH19_1-E6xI2C6-ALB8 |
| 517. | CH19_2G6_302xI2C6-ALB8 |
| 518. | CH19_2G6_302_VKGxI2C6-ALB23 |
| 519. | CH19_0-E11xI2C6-ALB23 |
| 520. | CH19_5-G4xI2C6-ALB23 |
| 521. | CH19_8-H6xI2C6-ALB23 |
| 522. | CH19_2-C11xI2C6-ALB23 |
| 523. | CH19_2-A10xI2C6-ALB23 |
| 524. | CH19_1-D11xI2C6-ALB23 |
| 525. | CH19_9-F9xI2C6-ALB23 |
| 526. | CH19_1-H8xI2C6-ALB23 |
| 527. | CH19_1-B12xI2C6-ALB23 |
| 528. | CH19_0-C4xI2C6-ALB23 |

| | Sequence Table |
|---|---|
| 529. | CH19__3-F2xI2C6-ALB23 |
| 530. | CH19__3-B10xI2C6-ALB23 |
| 531. | CH19__0-G4xI2C6-ALB23 |
| 532. | CH19__0-H5xI2C6-ALB23 |
| 533. | CH19__0-B8xI2C6-ALB23 |
| 534. | CH19__2-D9xI2C6-ALB23 |
| 535. | CH19__8-H7xI2C6-ALB23 |
| 536. | CH19__9-C2xI2C6-ALB23 |
| 537. | CH19__3-D5xI2C6-ALB23 |
| 538. | CH19__1-G11xI2C6-ALB23 |
| 539. | CH19__1-H11xI2C6-ALB23 |
| 540. | CH19__9-F3xI2C6-ALB23 |
| 541. | CH19__2-G6xI2C6-ALB23 |
| 542. | CH19__2-H7xI2C6-ALB23 |
| 543. | CH19__5-B3xI2C6-ALB23 |
| 544. | CH19__5-E10xI2C6-ALB23 |
| 545. | CH19__6-G10xI2C6-ALB23 |
| 546. | CH19__4-H8xI2C6-ALB23 |
| 547. | CH19__2-E4xI2C6-ALB23 |
| 548. | CH19__6-B8xI2C6-ALB23 |
| 549. | CH19__0-B4xI2C6-ALB23 |
| 550. | CH19__9-F1xI2C6-ALB23 |
| 551. | CH19__4-A7xI2C6-ALB23 |
| 552. | CH19__6-E12xI2C6-ALB23 |
| 553. | CH19__6-C12xI2C6-ALB23 |
| 554. | CH19__6-A7xI2C6-ALB23 |
| 555. | CH19__6-G8xI2C6-ALB23 |
| 556. | CH19__6-F9xI2C6-ALB23 |
| 557. | CH19__0-C11xI2C6-ALB23 |
| 558. | CH19__8-F6xI2C6-ALB23 |
| 559. | CH19__0-G9xI2C6-ALB23 |
| 560. | CH19__1-E11xI2C6-ALB23 |
| 561. | CH19__0-F5xI2C6-ALB23 |
| 562. | CH19__1-E1xI2C6-ALB23 |
| 563. | CH19__1-E6xI2C6-ALB23 |
| 564. | CH19__2G6__302xI2C6-ALB23 |
| 565. | CH19__2G6__302__VKGxI2C6-HALBwD |
| 566. | CH19__0-E11xI2C6-HALBwD |

-continued

| | Sequence Table |
|---|---|
| 567. | CH19__5-G4xI2C6-HALBwD |
| 568. | CH19__8-H6xI2C6-HALBwD |
| 569. | CH19__2-C11xI2C6-HALBwD |
| 570. | CH19__2-A10xI2C6-HALBwD |
| 571. | CH19__1-D11xI2C6-HALBwD |
| 572. | CH19__9-F9xI2C6-HALBwD |
| 573. | CH19__1-H8xI2C6-HALBwD |
| 574. | CH19__1-B12xI2C6-HALBwD |
| 575. | CH19__0-C4xI2C6-HALBwD |
| 576. | CH19__3-F2xI2C6-HALBwD |
| 577. | CH19__3-B10xI2C6-HALBwD |
| 578. | CH19__0-G4xI2C6-HALBwD |
| 579. | CH19__0-H5xI2C6-HALBwD |
| 580. | CH19__0-B8xI2C6-HALBwD |
| 581. | CH19__2-D9xI2C6-HALBwD |
| 582. | CH19__8-H7xI2C6-HALBwD |
| 583. | CH19__9-C2xI2C6-HALBwD |
| 584. | CH19__3-D5xI2C6-HALBwD |
| 585. | CH19__1-G11xI2C6-HALBwD |
| 586. | CH19__1-H11xI2C6-HALBwD |
| 587. | CH19__9-F3xI2C6-HALBwD |
| 588. | CH19__2-G6xI2C6-HALBwD |
| 589. | CH19__2-H7xI2C6-HALBwD |
| 590. | CH19__5-B3xI2C6-HALBwD |
| 591. | CH19__5-E10xI2C6-HALBwD |
| 592. | CH19__6-G10xI2C6-HALBwD |
| 593. | CH19__4-H8xI2C6-HALBwD |
| 594. | CH19__2-E4xI2C6-HALBwD |
| 595. | CH19__6-B8xI2C6-HALBwD |
| 596. | CH19__0-B4xI2C6-HALBwD |
| 597. | CH19__9-F1xI2C6-HALBwD |
| 598. | CH19__4-A7xI2C6-HALBwD |
| 599. | CH19__6-E12xI2C6-HALBwD |

-continued

| | Sequence Table |
|---|---|
| 600. | CH19_6-C12xI2C6-HALBwD |
| 601. | CH19_6-A7xI2C6-HALBwD |
| 602. | CH19_6-G8xI2C6-HALBwD |
| 603. | CH19_6-F9xI2C6-HALBwD |
| 604. | CH19_0-C11xI2C6-HALBwD |
| 605. | CH19_8-F6xI2C6-HALBwD |
| 606. | CH19_0-G9xI2C6-HALBwD |
| 607. | CH19_1-E11xI2C6-HALBwD |
| 608. | CH19_0-F5xI2C6-HALBwD |
| 609. | CH19_1-E1xI2C6-HALBwD |
| 610. | CH19_1-E6xI2C6-HALBwD |
| 611. | CH19_2G6_302xI2C6-HALBwD |
| 612. | CH19_2G6_302_VKGxI2C6-HALB |
| 613. | CH19_0-E11xI2C6-HALB |
| 614. | CH19_5-G4xI2C6-HALB |
| 615. | CH19_8-H6xI2C6-HALB |
| 616. | CH19_2-C11xI2C6-HALB |
| 617. | CH19_2-A10xI2C6-HALB |
| 618. | CH19_1-D11xI2C6-HALB |
| 619. | CH19_9-F9xI2C6-HALB |
| 620. | CH19_1-H8xI2C6-HALB |
| 621. | CH19_1-B12xI2C6-HALB |
| 622. | CH19_0-C4xI2C6-HALB |
| 623. | CH19_3-F2xI2C6-HALB |
| 624. | CH19_3-B10xI2C6-HALB |
| 625. | CH19_0-G4xI2C6-HALB |
| 626. | CH19_0-H5xI2C6-HALB |
| 627. | CH19_0-B8xI2C6-HALB |
| 628. | CH19_2-D9xI2C6-HALB |
| 629. | CH19_8-H7xI2C6-HALB |
| 630. | CH19_9-C2xI2C6-HALB |
| 631. | CH19_3-D5xI2C6-HALB |
| 632. | CH19_1-G11xI2C6-HALB |
| 633. | CH19_1-H11xI2C6-HALB |
| 634. | CH19_9-F3xI2C6-HALB |
| 635. | CH19_2-G6xI2C6-HALB |
| 636. | CH19_2-H7xI2C6-HALB |

-continued

| Sequence Table | |
|---|---|
| 637. | CH19_5-B3xI2C6-HALB |
| 638. | CH19_5-E10xI2C6-HALB |
| 639. | CH19_6-G10xI2C6-HALB |
| 640. | CH19_4-H8xI2C6-HALB |
| 641. | CH19_2-E4xI2C6-HALB |
| 642. | CH19_6-B8xI2C6-HALB |
| 643. | CH19_0-B4xI2C6-HALB |
| 644. | CH19_9-F1xI2C6-HALB |
| 645. | CH19_4-A7xI2C6-HALB |
| 646. | CH19_6-E12xI2C6-HALB |
| 647. | CH19_6-C12xI2C6-HALB |
| 648. | CH19_6-A7xI2C6-HALB |
| 649. | CH19_6-G8xI2C6-HALB |
| 650. | CH19_6-F9xI2C6-HALB |
| 651. | CH19_0-C11xI2C6-HALB |
| 652. | CH19_8-F6xI2C6-HALB |
| 653. | CH19_0-G9xI2C6-HALB |
| 654. | CH19_1-E11xI2C6-HALB |
| 655. | CH19_0-F5xI2C6-HALB |
| 656. | CH19_1-E1xI2C6-HALB |
| 657. | CH19_1-E6xI2C6-HALB |
| 658. | CH19_2G6_302xI2C6-HALB |
| 659. | CH19_2G6_302_VKGxI2C6-HALB7 |
| 660. | CH19_0-E11xI2C6-HALB7 |
| 661. | CH19_5-G4xI2C6-HALB7 |
| 662. | CH19_8-H6xI2C6-HALB7 |
| 663. | CH19_2-C11xI2C6-HALB7 |
| 664. | CH19_2-A10xI2C6-HALB7 |
| 665. | CH19_1-D11xI2C6-HALB7 |
| 666. | CH19_9-F9xI2C6-HALB7 |
| 667. | CH19_1-H8xI2C6-HALB7 |
| 668. | CH19_1-B12xI2C6-HALB7 |
| 669. | CH19_0-C4xI2C6-HALB7 |
| 670. | CH19_3-F2xI2C6-HALB7 |
| 671. | CH19_3-B10xI2C6-HALB7 |
| 672. | CH19_0-G4xI2C6-HALB7 |
| 673. | CH19_0-H5xI2C6-HALB7 |
| 674. | CH19_0-B8xI2C6-HALB7 |

-continued

| | Sequence Table |
|---|---|
| 675. | CH19__2-D9xI2C6-HALB7 |
| 676. | CH19__8-H7xI2C6-HALB7 |
| 677. | CH19__9-C2xI2C6-HALB7 |
| 678. | CH19__3-D5xI2C6-HALB7 |
| 679. | CH19__1-G11xI2C6-HALB7 |
| 680. | CH19__1-H11xI2C6-HALB7 |
| 681. | CH19__9-F3xI2C6-HALB7 |
| 682. | CH19__2-G6xI2C6-HALB7 |
| 683. | CH19__2-H7xI2C6-HALB7 |
| 684. | CH19__5-B3xI2C6-HALB7 |
| 685. | CH19__5-E10xI2C6-HALB7 |
| 686. | CH19__6-G10xI2C6-HALB7 |
| 687. | CH19__4-H8xI2C6-HALB7 |
| 688. | CH19__2-E4xI2C6-HALB7 |
| 689. | CH19__6-B8xI2C6-HALB7 |
| 690. | CH19__0-B4xI2C6-HALB7 |
| 691. | CH19__9-F1xI2C6-HALB7 |
| 692. | CH19__4-A7xI2C6-HALB7 |
| 693. | CH19__6-E12xI2C6-HALB7 |
| 694. | CH19__6-C12xI2C6-HALB7 |
| 695. | CH19__6-A7xI2C6-HALB7 |
| 696. | CH19__6-G8xI2C6-HALB7 |
| 697. | CH19__6-F9xI2C6-HALB7 |
| 698. | CH19__0-C11xI2C6-HALB7 |
| 699. | CH19__8-F6xI2C6-HALB7 |
| 700. | CH19__0-G9xI2C6-HALB7 |
| 701. | CH19__1-E11xI2C6-HALB7 |
| 702. | CH19__0-F5xI2C6-HALB7 |
| 703. | CH19__1-E1xI2C6-HALB7 |
| 704. | CH19__1-E6xI2C6-HALB7 |
| 705. | CH19__2G6__302xI2C6-HALB7 |
| 706. | CH19__2G6__302__VKGxI2C6-HALB098 |
| 707. | CH19__0-E11xI2C6-HALB098 |
| 708. | CH19__5-G4xI2C6-HALB098 |
| 709. | CH19__8-H6xI2C6-HALB098 |
| 710. | CH19__2-C11xI2C6-HALB098 |
| 711. | CH19__2-A10xI2C6-HALB098 |

-continued

| | Sequence Table | |
|---|---|---|
| 712. | CH19__1-D11xI2C6-HALB098 | |
| 713. | CH19__9-F9xI2C6-HALB098 | |
| 714. | CH19__1-H8xI2C6-HALB098 | |
| 715. | CH19__1-B12xI2C6-HALB098 | |
| 716. | CH19__0-C4xI2C6-HALB098 | |
| 717. | CH19__3-F2xI2C6-HALB098 | |
| 718. | CH19__3-B10xI2C6-HALB098 | |
| 719. | CH19__0-G4xI2C6-HALB098 | |
| 720. | CH19__0-H5xI2C6-HALB098 | |
| 721. | CH19__0-B8xI2C6-HALB098 | |
| 722. | CH19__2-D9xI2C6-HALB098 | |
| 723. | CH19__8-H7xI2C6-HALB098 | |
| 724. | CH19__9-C2xI2C6-HALB098 | |
| 725. | CH19__3-D5xI2C6-HALB098 | |
| 726. | CH19__1-G11xI2C6-HALB098 | |
| 727. | CH19__1-H11xI2C6-HALB098 | |
| 728. | CH19__9-F3xI2C6-HALB098 | |
| 729. | CH19__2-G6xI2C6-HALB098 | |
| 730. | CH19__2-H7xI2C6-HALB098 | |
| 731. | CH19__5-B3xI2C6-HALB098 | |
| 732. | CH19__5-E10xI2C6-HALB098 | |
| 733. | CH19__6-G10xI2C6-HALB098 | |
| 734. | CH19__4-H8xI2C6-HALB098 | |
| 735. | CH19__2-E4xI2C6-HALB098 | |
| 736. | CH19__6-B8xI2C6-HALB098 | |
| 737. | CH19__0-B4xI2C6-HALB098 | |
| 738. | CH19__9-F1xI2C6-HALB098 | |
| 739. | CH19__4-A7xI2C6-HALB098 | |
| 740. | CH19__6-E12xI2C6-HALB098 | |
| 741. | CH19__6-C12xI2C6-HALB098 | |
| 742. | CH19__6-A7xI2C6-HALB098 | |
| 743. | CH19__6-G8xI2C6-HALB098 | |
| 744. | CH19__6-F9xI2C6-HALB098 | |

-continued

| Sequence Table | | |
|---|---|---|
| 745. | CH19_0-C11xI2C6-HALB098 | |
| 746. | CH19_8-F6xI2C6-HALB098 | |
| 747. | CH19_0-G9xI2C6-HALB098 | |
| 748. | CH19_1-E11xI2C6-HALB098 | |
| 749. | CH19_0-F5xI2C6-HALB098 | |
| 750. | CH19_1-E1xI2C6-HALB098 | |
| 751. | CH19_1-E6xI2C6-HALB098 | |
| 752. | CH19_2G6_302xI2C6-HALB098 | |
| 753. | CH19_2G6_302_VKGxI2C6-HALB114 | |
| 754. | CH19_0-E11xI2C6-HALB114 | |
| 755. | CH19_5-G4xI2C6-HALB114 | |
| 756. | CH19_8-H6xI2C6-HALB114 | |
| 757. | CH19_2-C11xI2C6-HALB114 | |
| 758. | CH19_2-A10xI2C6-HALB114 | |
| 759. | CH19_1-D11xI2C6-HALB114 | |
| 760. | CH19_9-F9xI2C6-HALB114 | |
| 761. | CH19_1-H8xI2C6-HALB114 | |
| 762. | CH19_1-B12xI2C6-HALB114 | |
| 763. | CH19_0-C4xI2C6-HALB114 | |
| 764. | CH19_3-F2xI2C6-HALB114 | |
| 765. | CH19_3-B10xI2C6-HALB114 | |
| 766. | CH19_0-G4xI2C6-HALB114 | |
| 767. | CH19_0-H5xI2C6-HALB114 | |
| 768. | CH19_0-B8xI2C6-HALB114 | |
| 769. | CH19_2-D9xI2C6-HALB114 | |
| 770. | CH19_8-H7xI2C6-HALB114 | |
| 771. | CH19_9-C2xI2C6-HALB114 | |
| 772. | CH19_3-D5xI2C6-HALB114 | |
| 773. | CH19_1-G11xI2C6-HALB114 | |
| 774. | CH19_1-H11xI2C6-HALB114 | |
| 775. | CH19_9-F3xI2C6-HALB114 | |
| 776. | CH19_2-G6xI2C6-HALB114 | |
| 777. | CH19_2-H7xI2C6-HALB114 | |

| | Sequence Table |
|---|---|
| 778. | CH19__5-B3xI2C6-HALB114 |
| 779. | CH19__5-E10xI2C6-HALB114 |
| 780. | CH19__6-G10xI2C6-HALB114 |
| 781. | CH19__4-H8xI2C6-HALB114 |
| 782. | CH19__2-E4xI2C6-HALB114 |
| 783. | CH19__6-B8xI2C6-HALB114 |
| 784. | CH19__0-B4xI2C6-HALB114 |
| 785. | CH19__9-F1xI2C6-HALB114 |
| 786. | CH19__4-A7xI2C6-HALB114 |
| 787. | CH19__6-E12xI2C6-HALB114 |
| 788. | CH19__6-C12xI2C6-HALB114 |
| 789. | CH19__6-A7xI2C6-HALB114 |
| 790. | CH19__6-G8xI2C6-HALB114 |
| 791. | CH19__6-F9xI2C6-HALB114 |
| 792. | CH19__0-C11xI2C6-HALB114 |
| 793. | CH19__8-F6xI2C6-HALB114 |
| 794. | CH19__0-G9xI2C6-HALB114 |
| 795. | CH19__1-E11xI2C6-HALB114 |
| 796. | CH19__0-F5xI2C6-HALB114 |
| 797. | CH19__1-E1xI2C6-HALB114 |
| 798. | CH19__1-E6xI2C6-HALB114 |
| 799. | CH19__2G6__302xI2C6-HALB114 |
| 800. | CH19__2G6__302__VKGxI2C6-HALB254 |
| 801. | CH19__0-E11xI2C6-HALB254 |
| 802. | CH19__5-G4xI2C6-HALB254 |
| 803. | CH19__8-H6xI2C6-HALB254 |
| 804. | CH19__2-C11xI2C6-HALB254 |
| 805. | CH19__2-A10xI2C6-HALB254 |
| 806. | CH19__1-D11xI2C6-HALB254 |
| 807. | CH19__9-F9xI2C6-HALB254 |
| 808. | CH19__1-H8xI2C6-HALB254 |
| 809. | CH19__1-B12xI2C6-HALB254 |
| 810. | CH19__0-C4xI2C6-HALB254 |

-continued

| | Sequence Table |
|---|---|
| 811. | CH19__3-F2xI2C6-HALB254 |
| 812. | CH19__3-B10xI2C6-HALB254 |
| 813. | CH19__0-G4xI2C6-HALB254 |
| 814. | CH19__0-H5xI2C6-HALB254 |
| 815. | CH19__0-B8xI2C6-HALB254 |
| 816. | CH19__2-D9xI2C6-HALB254 |
| 817. | CH19__8-H7xI2C6-HALB254 |
| 818. | CH19__9-C2xI2C6-HALB254 |
| 819. | CH19__3-D5xI2C6-HALB254 |
| 820. | CH19__1-G11xI2C6-HALB254 |
| 821. | CH19__1-H11xI2C6-HALB254 |
| 822. | CH19__9-F3xI2C6-HALB254 |
| 823. | CH19__2-G6xI2C6-HALB254 |
| 824. | CH19__2-H7xI2C6-HALB254 |
| 825. | CH19__5-B3xI2C6-HALB254 |
| 826. | CH19__5-E10xI2C6-HALB254 |
| 827. | CH19__6-G10xI2C6-HALB254 |
| 828. | CH19__4-H8xI2C6-HALB254 |
| 829. | CH19__2-E4xI2C6-HALB254 |
| 830. | CH19__6-B8xI2C6-HALB254 |
| 831. | CH19__0-B4xI2C6-HALB254 |
| 832. | CH19__9-F1xI2C6-HALB254 |
| 833. | CH19__4-A7xI2C6-HALB254 |
| 834. | CH19__6-E12xI2C6-HALB254 |
| 835. | CH19__6-C12xI2C6-HALB254 |
| 836. | CH19__6-A7xI2C6-HALB254 |
| 837. | CH19__6-G8xI2C6-HALB254 |
| 838. | CH19__6-F9xI2C6-HALB254 |
| 839. | CH19__0-C11xI2C6-HALB254 |
| 840. | CH19__8-F6xI2C6-HALB254 |
| 841. | CH19__0-G9xI2C6-HALB254 |
| 842. | CH19__1-E11xI2C6-HALB254 |
| 843. | CH19__0-F5xI2C6-HALB254 |
| 844. | CH19__1-E1xI2C6-HALB254 |

| | Sequence Table |
|---|---|
| 845. | CH19__1-E6xI2C6-HALB254 |
| 846. | CH19__2G6__302xI2C6-HALB254 |
| 847. | CH19__2G6__302__VKGxI2C6-CH-FcB-LH |
| 848. | CH19__0-E11xI2C6-CH-FcB-LH |
| 849. | CH19__5-G4xI2C6-CH-FcB-LH |
| 850. | CH19__8-H6xI2C6-CH-FcB-LH |
| 851. | CH19__2-C11xI2C6-CH-FcB-LH |
| 852. | CH19__2-A10xI2C6-CH-FcB-LH |
| 853. | CH19__1-D11xI2C6-CH-FcB-LH |
| 854. | CH19__9-F9xI2C6-CH-FcB-LH |
| 855. | CH19__1-H8xI2C6-CH-FcB-LH |
| 856. | CH19__1-B12xI2C6-CH-FcB-LH |
| 857. | CH19__0-C4xI2C6-CH-FcB-LH |
| 858. | CH19__3-F2xI2C6-CH-FcB-LH |
| 859. | CH19__3-B10xI2C6-CH-FcB-LH |
| 860. | CH19__0-G4xI2C6-CH-FcB-LH |
| 861. | CH19__0-H5xI2C6-CH-FcB-LH |
| 862. | CH19__0-B8xI2C6-CH-FcB-LH |
| 863. | CH19__2-D9xI2C6-CH-FcB-LH |
| 864. | CH19__8-H7xI2C6-CH-FcB-LH |
| 865. | CH19__9-C2xI2C6-CH-FcB-LH |
| 866. | CH19__3-D5xI2C6-CH-FcB-LH |
| 867. | CH19__1-G11xI2C6-CH-FcB-LH |
| 868. | CH19__1-H11xI2C6-CH-FcB-LH |
| 869. | CH19__9-F3xI2C6-CH-FcB-LH |
| 870. | CH19__2-G6xI2C6-CH-FcB-LH |
| 871. | CH19__2-H7xI2C6-CH-FcB-LH |
| 872. | CH19__5-B3xI2C6-CH-FcB-LH |
| 873. | CH19__5-E10xI2C6-CH-FcB-LH |
| 874. | CH19__6-G10xI2C6-CH-FcB-LH |
| 875. | CH19__4-H8xI2C6-CH-FcB-LH |
| 876. | CH19__2-E4xI2C6-CH-FcB-LH |
| 877. | CH19__6-B8xI2C6-CH-FcB-LH |

| | Sequence Table |
|---|---|
| 878. | CH19__0-B4xI2C6-CH-FcB-LH |
| 879. | CH19__9-F1xI2C6-CH-FcB-LH |
| 880. | CH19__4-A7xI2C6-CH-FcB-LH |
| 881. | CH19__6-E12xI2C6-CH-FcB-LH |
| 882. | CH19__6-C12xI2C6-CH-FcB-LH |
| 883. | CH19__6-A7xI2C6-CH-FcB-LH |
| 884. | CH19__6-G8xI2C6-CH-FcB-LH |
| 885. | CH19__6-F9xI2C6-CH-FcB-LH |
| 886. | CH19__0-C11xI2C6-CH-FcB-LH |
| 887. | CH19__8-F6xI2C6-CH-FcB-LH |
| 888. | CH19__0-G9xI2C6-CH-FcB-LH |
| 889. | CH19__1-E11xI2C6-CH-FcB-LH |
| 890. | CH19__0-F5xI2C6-CH-FcB-LH |
| 891. | CH19__1-E1xI2C6-CH-FcB-LH |
| 892. | CH19__1-E6xI2C6-CH-FcB-LH |
| 893. | CH19__2G6__302xI2C6-CH-FcB-LH |
| 894. | CH19__2G6__302__VKGxI2C6-CH-FcB-LY |
| 895. | CH19__0-E11xI2C6-CH-FcB-LY |
| 896. | CH19__5-G4xI2C6-CH-FcB-LY |
| 897. | CH19__8-H6xI2C6-CH-FcB-LY |
| 898. | CH19__2-C11xI2C6-CH-FcB-LY |
| 899. | CH19__2-A10xI2C6-CH-FcB-LY |
| 900. | CH19__1-D11xI2C6-CH-FcB-LY |
| 901. | CH19__9-F9xI2C6-CH-FcB-LY |
| 902. | CH19__1-H8xI2C6-CH-FcB-LY |
| 903. | CH19__1-B12xI2C6-CH-FcB-LY |
| 904. | CH19__0-C4xI2C6-CH-FcB-LY |
| 905. | CH19__3-F2xI2C6-CH-FcB-LY |
| 906. | CH19__3-B10xI2C6-CH-FcB-LY |
| 907. | CH19__0-G4xI2C6-CH-FcB-LY |
| 908. | CH19__0-H5xI2C6-CH-FcB-LY |
| 909. | CH19__0-B8xI2C6-CH-FcB-LY |
| 910. | CH19__2-D9xI2C6-CH-FcB-LY |

-continued

| | Sequence Table |
|---|---|
| 911. | CH19__8-H7xI2C6-CH-FcB-LY |
| 912. | CH19__9-C2xI2C6-CH-FcB-LY |
| 913. | CH19__3-D5xI2C6-CH-FcB-LY |
| 914. | CH19__1-G11xI2C6-CH-FcB-LY |
| 915. | CH19__1-H11xI2C6-CH-FcB-LY |
| 916. | CH19__9-F3xI2C6-CH-FcB-LY |
| 917. | CH19__2-G6xI2C6-CH-FcB-LY |
| 918. | CH19__2-H7xI2C6-CH-FcB-LY |
| 919. | CH19__5-B3xI2C6-CH-FcB-LY |
| 920. | CH19__5-E10xI2C6-CH-FcB-LY |
| 921. | CH19__6-G10xI2C6-CH-FcB-LY |
| 922. | CH19__4-H8xI2C6-CH-FcB-LY |
| 923. | CH19__2-E4xI2C6-CH-FcB-LY |
| 924. | CH19__6-B8xI2C6-CH-FcB-LY |
| 925. | CH19__0-B4xI2C6-CH-FcB-LY |
| 926. | CH19__9-F1xI2C6-CH-FcB-LY |
| 927. | CH19__4-A7xI2C6-CH-FcB-LY |
| 928. | CH19__6-E12xI2C6-CH-FcB-LY |
| 929. | CH19__6-C12xI2C6-CH-FcB-LY |
| 930. | CH19__6-A7xI2C6-CH-FcB-LY |
| 931. | CH19__6-G8xI2C6-CH-FcB-LY |
| 932. | CH19__6-F9xI2C6-CH-FcB-LY |
| 933. | CH19__0-C11xI2C6-CH-FcB-LY |
| 934. | CH19__8-F6xI2C6-CH-FcB-LY |
| 935. | CH19__0-G9xI2C6-CH-FcB-LY |
| 936. | CH19__1-E11xI2C6-CH-FcB-LY |
| 937. | CH19__0-F5xI2C6-CH-FcB-LY |
| 938. | CH19__1-E1xI2C6-CH-FcB-LY |
| 939. | CH19__1-E6xI2C6-CH-FcB-LY |
| 940. | CH19__2G6__302xI2C6-CH-FcB-LY |
| 941. | CH19__2G6__302_VKGxI2C6-HALB253 |
| 942. | CH19__0-E11xI2C6-HALB253 |
| 943. | CH19__5-G4xI2C6-HALB253 |
| 944. | CH19__8-H6xI2C6-HALB253 |

-continued

| | Sequence Table |
|---|---|
| 945. | CH19__2-C11xI2C6-HALB253 |
| 946. | CH19__2-A10xI2C6-HALB253 |
| 947. | CH19__1-D11xI2C6-HALB253 |
| 948. | CH19__9-F9xI2C6-HALB253 |
| 949. | CH19__1-H8xI2C6-HALB253 |
| 950. | CH19__1-B12xI2C6-HALB253 |
| 951. | CH19__0-C4xI2C6-HALB253 |
| 952. | CH19__3-F2xI2C6-HALB253 |
| 953. | CH19__3-B10xI2C6-HALB253 |
| 954. | CH19__0-G4xI2C6-HALB253 |
| 955. | CH19__0-H5xI2C6-HALB253 |
| 956. | CH19__0-B8xI2C6-HALB253 |
| 957. | CH19__2-D9xI2C6-HALB253 |
| 958. | CH19__8-H7xI2C6-HALB253 |
| 959. | CH19__9-C2xI2C6-HALB253 |
| 960. | CH19__3-D5xI2C6-HALB253 |
| 961. | CH19__1-G11xI2C6-HALB253 |
| 962. | CH19__1-H11xI2C6-HALB253 |
| 963. | CH19__9-F3xI2C6-HALB253 |
| 964. | CH19__2-G6xI2C6-HALB253 |
| 965. | CH19__2-H7xI2C6-HALB253 |
| 966. | CH19__5-B3xI2C6-HALB253 |
| 967. | CH19__5-E10xI2C6-HALB253 |
| 968. | CH19__6-G10xI2C6-HALB253 |
| 969. | CH19__4-H8xI2C6-HALB253 |
| 970. | CH19__2-E4xI2C6-HALB253 |
| 971. | CH19__6-B8xI2C6-HALB253 |
| 972. | CH19__0-B4xI2C6-HALB253 |
| 973. | CH19__9-F1xI2C6-HALB253 |
| 974. | CH19__4-A7xI2C6-HALB253 |
| 975. | CH19__6-E12xI2C6-HALB253 |
| 976. | CH19__6-C12xI2C6-HALB253 |
| 977. | CH19__6-A7xI2C6-HALB253 |

-continued

| | Sequence Table |
|---|---|
| 978. | CH19__6-G8xI2C6-HALB253 |
| 979. | CH19__6-F9xI2C6-HALB253 |
| 980. | CH19__0-C11xI2C6-HALB253 |
| 981. | CH19__8-F6xI2C6-HALB253 |
| 982. | CH19__0-G9xI2C6-HALB253 |
| 983. | CH19__1-E11xI2C6-HALB253 |
| 984. | CH19__0-F5xI2C6-HALB253 |
| 985. | CH19__1-E1xI2C6-HALB253 |
| 986. | CH19__1-E6xI2C6-HALB253 |
| 987. | CH19__2G6__302xI2C6-HALB253 |
| 988. | CH19__2G6__302__VKGxI2C6-HALB131 |
| 989. | CH19__0-E11xI2C6-HALB131 |
| 990. | CH19__5-G4xI2C6-HALB131 |
| 991. | CH19__8-H6xI2C6-HALB131 |
| 992. | CH19__2-C11xI2C6-HALB131 |
| 993. | CH19__2-A10xI2C6-HALB131 |
| 994. | CH19__1-D11xI2C6-HALB131 |
| 995. | CH19__9-F9xI2C6-HALB131 |
| 996. | CH19__1-H8xI2C6-HALB131 |
| 997. | CH19__1-B12xI2C6-HALB131 |
| 998. | CH19__0-C4xI2C6-HALB131 |
| 999. | CH19__3-F2xI2C6-HALB131 |
| 1000. | CH19__3-B10xI2C6-HALB131 |
| 1001. | CH19__0-G4xI2C6-HALB131 |
| 1002. | CH19__0-H5xI2C6-HALB131 |
| 1003. | CH19__0-B8xI2C6-HALB131 |
| 1004. | CH19__2-D9xI2C6-HALB131 |
| 1005. | CH19__8-H7xI2C6-HALB131 |
| 1006. | CH19__9-C2xI2C6-HALB131 |
| 1007. | CH19__3-D5xI2C6-HALB131 |
| 1008. | CH19__1-G11xI2C6-HALB131 |
| 1009. | CH19__1-H11xI2C6-HALB131 |
| 1010. | CH19__9-F3xI2C6-HALB131 |

-continued

| Sequence Table | | |
|---|---|---|
| 1011. | CH19__2-G6xI2C6-HALB131 | |
| 1012. | CH19__2-H7xI2C6-HALB131 | |
| 1013. | CH19__5-B3xI2C6-HALB131 | |
| 1014. | CH19__5-E10xI2C6-HALB131 | |
| 1015. | CH19__6-G10xI2C6-HALB131 | |
| 1016. | CH19__4-H8xI2C6-HALB131 | |
| 1017. | CH19__2-E4xI2C6-HALB131 | |
| 1018. | CH19__6-B8xI2C6-HALB131 | |
| 1019. | CH19__0-B4xI2C6-HALB131 | |
| 1020. | CH19__9-F1xI2C6-HALB131 | |
| 1021. | CH19__4-A7xI2C6-HALB131 | |
| 1022. | CH19__6-E12xI2C6-HALB131 | |
| 1023. | CH19__6-C12xI2C6-HALB131 | |
| 1024. | CH19__6-A7xI2C6-HALB131 | |
| 1025. | CH19__6-G8xI2C6-HALB131 | |
| 1026. | CH19__6-F9xI2C6-HALB131 | |
| 1027. | CH19__0-C11xI2C6-HALB131 | |
| 1028. | CH19__8-F6xI2C6-HALB131 | |
| 1029. | CH19__0-G9xI2C6-HALB131 | |
| 1030. | CH19__1-E11xI2C6-HALB131 | |
| 1031. | CH19__0-F5xI2C6-HALB131 | |
| 1032. | CH19__1-E1xI2C6-HALB131 | |
| 1033. | CH19__1-E6xI2C6-HALB131 | |
| 1034. | CH19__2G6__302xI2C6-HALB131 | |
| 1035. | CH19__2G6__302__VKGxI2C6-HALB135 | |
| 1036. | CH19__0-E11xI2C6-HALB135 | |
| 1037. | CH19__5-G4xI2C6-HALB135 | |
| 1038. | CH19__8-H6xI2C6-HALB135 | |
| 1039. | CH19__2-C11xI2C6-HALB135 | |
| 1040. | CH19__2-A10xI2C6-HALB135 | |
| 1041. | CH19__1-D11xI2C6-HALB135 | |
| 1042. | CH19__9-F9xI2C6-HALB135 | |
| 1043. | CH19__1-H8xI2C6-HALB135 | |

-continued

| | Sequence Table |
|---|---|
| 1044. | CH19_1-B12xI2C6-HALB135 |
| 1045. | CH19_0-C4xI2C6-HALB135 |
| 1046. | CH19_3-F2xI2C6-HALB135 |
| 1047. | CH19_3-B10xI2C6-HALB135 |
| 1048. | CH19_0-G4xI2C6-HALB135 |
| 1049. | CH19_0-H5xI2C6-HALB135 |
| 1050. | CH19_0-B8xI2C6-HALB135 |
| 1051. | CH19_2-D9xI2C6-HALB135 |
| 1052. | CH19_8-H7xI2C6-HALB135 |
| 1053. | CH19_9-C2xI2C6-HALB135 |
| 1054. | CH19_3-D5xI2C6-HALB135 |
| 1055. | CH19_1-G11xI2C6-HALB135 |
| 1056. | CH19_1-H11xI2C6-HALB135 |
| 1057. | CH19_9-F3xI2C6-HALB135 |
| 1058. | CH19_2-G6xI2C6-HALB135 |
| 1059. | CH19_2-H7xI2C6-HALB135 |
| 1060. | CH19_5-B3xI2C6-HALB135 |
| 1061. | CH19_5-E10xI2C6-HALB135 |
| 1062. | CH19_6-G10xI2C6-HALB135 |
| 1063. | CH19_4-H8xI2C6-HALB135 |
| 1064. | CH19_2-E4xI2C6-HALB135 |
| 1065. | CH19_6-B8xI2C6-HALB135 |
| 1066. | CH19_0-B4xI2C6-HALB135 |
| 1067. | CH19_9-F1xI2C6-HALB135 |
| 1068. | CH19_4-A7xI2C6-HALB135 |
| 1069. | CH19_6-E12xI2C6-HALB135 |
| 1070. | CH19_6-C12xI2C6-HALB135 |
| 1071. | CH19_6-A7xI2C6-HALB135 |
| 1072. | CH19_6-G8xI2C6-HALB135 |
| 1073. | CH19_6-F9xI2C6-HALB135 |
| 1074. | CH19_0-C11xI2C6-HALB135 |
| 1075. | CH19_8-F6xI2C6-HALB135 |
| 1076. | CH19_0-G9xI2C6-HALB135 |

-continued

| | Sequence Table |
|---|---|
| 1077. | CH19_1-E11xI2C6-HALB135 |
| 1078. | CH19_0-F5xI2C6-HALB135 |
| 1079. | CH19_1-E1xI2C6-HALB135 |
| 1080. | CH19_1-E6xI2C6-HALB135 |
| 1081. | CH19_2G6_302xI2C6-HALB135 |
| 1082. | CH19_2G6_302_VKGxI2C6-HALB133 |
| 1083. | CH19_0-E11xI2C6-HALB133 |
| 1084. | CH19_5-G4xI2C6-HALB133 |
| 1085. | CH19_8-H6xI2C6-HALB133 |
| 1086. | CH19_2-C11xI2C6-HALB133 |
| 1087. | CH19_2-A10xI2C6-HALB133 |
| 1088. | CH19_1-D11xI2C6-HALB133 |
| 1089. | CH19_9-F9xI2C6-HALB133 |
| 1090. | CH19_1-H8xI2C6-HALB133 |
| 1091. | CH19_1-B12xI2C6-HALB133 |
| 1092. | CH19_0-C4xI2C6-HALB133 |
| 1093. | CH19_3-F2xI2C6-HALB133 |
| 1094. | CH19_3-B10xI2C6-HALB133 |
| 1095. | CH19_0-G4xI2C6-HALB133 |
| 1096. | CH19_0-H5xI2C6-HALB133 |
| 1097. | CH19_0-B8xI2C6-HALB133 |
| 1098. | CH19_2-D9xI2C6-HALB133 |
| 1099. | CH19_8-H7xI2C6-HALB133 |
| 1100. | CH19_9-C2xI2C6-HALB133 |
| 1101. | CH19_3-D5xI2C6-HALB133 |
| 1102. | CH19_1-G11xI2C6-HALB133 |
| 1103. | CH19_1-H11xI2C6-HALB133 |
| 1104. | CH19_9-F3xI2C6-HALB133 |
| 1105. | CH19_2-G6xI2C6-HALB133 |
| 1106. | CH19_2-H7xI2C6-HALB133 |
| 1107. | CH19_5-B3xI2C6-HALB133 |
| 1108. | CH19_5-E10xI2C6-HALB133 |
| 1109. | CH19_6-G10xI2C6-HALB133 |

-continued

| | Sequence Table |
|---|---|
| 1110. | CH19__4-H8xI2C6-HALB133 |
| 1111. | CH19__2-E4xI2C6-HALB133 |
| 1112. | CH19__6-B8xI2C6-HALB133 |
| 1113. | CH19__0-B4xI2C6-HALB133 |
| 1114. | CH19__9-F1xI2C6-HALB133 |
| 1115. | CH19__4-A7xI2C6-HALB133 |
| 1116. | CH19__6-E12xI2C6-HALB133 |
| 1117. | CH19__6-C12xI2C6-HALB133 |
| 1118. | CH19__6-A7xI2C6-HALB133 |
| 1119. | CH19__6-G8xI2C6-HALB133 |
| 1120. | CH19__6-F9xI2C6-HALB133 |
| 1121. | CH19__0-C11xI2C6-HALB133 |
| 1122. | CH19__8-F6xI2C6-HALB133 |
| 1123. | CH19__0-G9xI2C6-HALB133 |
| 1124. | CH19__1-E11xI2C6-HALB133 |
| 1125. | CH19__0-F5xI2C6-HALB133 |
| 1126. | CH19__1-E1xI2C6-HALB133 |
| 1127. | CH19__1-E6xI2C6-HALB133 |
| 1128. | CH19__2G6__302xI2C6-HALB133 |
| 1129. | CH19__2G6__302__VKGxI2C6-CH-FcB-LH-156 |
| 1130. | CH19__0-E11xI2C6-CH-FcB-LH-156 |
| 1131. | CH19__5-G4xI2C6-CH-FcB-LH-156 |
| 1132. | CH19__8-H6xI2C6-CH-FcB-LH-156 |
| 1133. | CH19__2-C11xI2C6-CH-FcB-LH-156 |
| 1134. | CH19__2-A10xI2C6-CH-FcB-LH-156 |
| 1135. | CH19__1-D11xI2C6-CH-FcB-LH-156 |
| 1136. | CH19__9-F9xI2C6-CH-FcB-LH-156 |
| 1137. | CH19__1-H8xI2C6-CH-FcB-LH-156 |
| 1138. | CH19__1-B12xI2C6-CH-FcB-LH-156 |
| 1139. | CH19__0-C4xI2C6-CH-FcB-LH-156 |
| 1140. | CH19__3-F2xI2C6-CH-FcB-LH-156 |
| 1141. | CH19__3-B10xI2C6-CH-FcB-LH-156 |
| 1142. | CH19__0-G4xI2C6-CH-FcB-LH-156 |

| | Sequence Table |
|---|---|
| 1143. | CH19__0-H5xI2C6-CH-FcB-LH-156 |
| 1144. | CH19__0-B8xI2C6-CH-FcB-LH-156 |
| 1145. | CH19__2-D9xI2C6-CH-FcB-LH-156 |
| 1146. | CH19__8-H7xI2C6-CH-FcB-LH-156 |
| 1147. | CH19__9-C2xI2C6-CH-FcB-LH-156 |
| 1148. | CH19__3-D5xI2C6-CH-FcB-LH-156 |
| 1149. | CH19__1-G11xI2C6-CH-FcB-LH-156 |
| 1150. | CH19__1-H11xI2C6-CH-FcB-LH-156 |
| 1151. | CH19__9-F3xI2C6-CH-FcB-LH-156 |
| 1152. | CH19__2-G6xI2C6-CH-FcB-LH-156 |
| 1153. | CH19__2-H7xI2C6-CH-FcB-LH-156 |
| 1154. | CH19__5-B3xI2C6-CH-FcB-LH-156 |
| 1155. | CH19__5-E10xI2C6-CH-FcB-LH-156 |
| 1156. | CH19__6-G10xI2C6-CH-FcB-LH-156 |
| 1157. | CH19__4-H8xI2C6-CH-FcB-LH-156 |
| 1158. | CH19__2-E4xI2C6-CH-FcB-LH-156 |
| 1159. | CH19__6-B8xI2C6-CH-FcB-LH-156 |
| 1160. | CH19__0-B4xI2C6-CH-FcB-LH-156 |
| 1161. | CH19__9-F1xI2C6-CH-FcB-LH-156 |
| 1162. | CH19__4-A7xI2C6-CH-FcB-LH-156 |
| 1163. | CH19__6-E12xI2C6-CH-FcB-LH-156 |
| 1164. | CH19__6-C12xI2C6-CH-FcB-LH-156 |
| 1165. | CH19__6-A7xI2C6-CH-FcB-LH-156 |
| 1166. | CH19__6-G8xI2C6-CH-FcB-LH-156 |
| 1167. | CH19__6-F9xI2C6-CH-FcB-LH-156 |
| 1168. | CH19__0-C11xI2C6-CH-FcB-LH-156 |
| 1169. | CH19__8-F6xI2C6-CH-FcB-LH-156 |
| 1170. | CH19__0-G9xI2C6-CH-FcB-LH-156 |
| 1171. | CH19__1-E11xI2C6-CH-FcB-LH-156 |
| 1172. | CH19__0-F5xI2C6-CH-FcB-LH-156 |
| 1173. | CH19__1-E1xI2C6-CH-FcB-LH-156 |
| 1174. | CH19__1-E6xI2C6-CH-FcB-LH-156 |
| 1175. | CH19__2G6__302xI2C6-CH-FcB-LH-156 |

-continued

Sequence Table

| | |
|---|---|
| 1176. | CH19__2G6__302__VKGxI2C6-CH-FcB-LY-156 |
| 1177. | CH19__0-E11xI2C6-CH-FcB-LY-156 |
| 1178. | CH19__5-G4xI2C6-CH-FcB-LY-156 |
| 1179. | CH19__8-H6xI2C6-CH-FcB-LY-156 |
| 1180. | CH19__2-C11xI2C6-CH-FcB-LY-156 |
| 1181. | CH19__2-A10xI2C6-CH-FcB-LY-156 |
| 1182. | CH19__1-D11xI2C6-CH-FcB-LY-156 |
| 1183. | CH19__9-F9xI2C6-CH-FcB-LY-156 |
| 1184. | CH19__1-H8xI2C6-CH-FcB-LY-156 |
| 1185. | CH19__1-B12xI2C6-CH-FcB-LY-156 |
| 1186. | CH19__0-C4xI2C6-CH-FcB-LY-156 |
| 1187. | CH19__3-F2xI2C6-CH-FcB-LY-156 |
| 1188. | CH19__3-B10xI2C6-CH-FcB-LY-156 |
| 1189. | CH19__0-G4xI2C6-CH-FcB-LY-156 |
| 1190. | CH19__0-H5xI2C6-CH-FcB-LY-156 |
| 1191. | CH19__0-B8xI2C6-CH-FcB-LY-156 |
| 1192. | CH19__2-D9xI2C6-CH-FcB-LY-156 |
| 1193. | CH19__8-H7xI2C6-CH-FcB-LY-156 |
| 1194. | CH19__9-C2xI2C6-CH-FcB-LY-156 |
| 1195. | CH19__3-D5xI2C6-CH-FcB-LY-156 |
| 1196. | CH19__1-G11xI2C6-CH-FcB-LY-156 |
| 1197. | CH19__1-H11xI2C6-CH-FcB-LY-156 |
| 1198. | CH19__9-F3xI2C6-CH-FcB-LY-156 |
| 1199. | CH19__2-G6xI2C6-CH-FcB-LY-156 |
| 1200. | CH19__2-H7xI2C6-CH-FcB-LY-156 |
| 1201. | CH19__5-B3xI2C6-CH-FcB-LY-156 |
| 1202. | CH19__5-E10xI2C6-CH-FcB-LY-156 |
| 1203. | CH19__6-G10xI2C6-CH-FcB-LY-156 |
| 1204. | CH19__4-H8xI2C6-CH-FcB-LY-156 |
| 1205. | CH19__2-E4xI2C6-CH-FcB-LY-156 |
| 1206. | CH19__6-B8xI2C6-CH-FcB-LY-156 |
| 1207. | CH19__0-B4xI2C6-CH-FcB-LY-156 |
| 1208. | CH19__9-F1xI2C6-CH-FcB-LY-156 |

| | Sequence Table |
|---|---|
| 1209. | CH19__4-A7xI2C6-CH-FcB-LY-156 |
| 1210. | CH19__6-E12xI2C6-CH-FcB-LY-156 |
| 1211. | CH19__6-C12xI2C6-CH-FcB-LY-156 |
| 1212. | CH19__6-A7xI2C6-CH-FcB-LY-156 |
| 1213. | CH19__6-G8xI2C6-CH-FcB-LY-156 |
| 1214. | CH19__6-F9xI2C6-CH-FcB-LY-156 |
| 1215. | CH19__0-C11xI2C6-CH-FcB-LY-156 |
| 1216. | CH19__8-F6xI2C6-CH-FcB-LY-156 |
| 1217. | CH19__0-G9xI2C6-CH-FcB-LY-156 |
| 1218. | CH19__1-E11xI2C6-CH-FcB-LY-156 |
| 1219. | CH19__0-F5xI2C6-CH-FcB-LY-156 |
| 1220. | CH19__1-E1xI2C6-CH-FcB-LY-156 |
| 1221. | CH19__1-E6xI2C6-CH-FcB-LY-156 |
| 1222. | CH19__2G6__302xI2C6-CH-FcB-LY-156 |
| 1223. | Human Cadherin-19 Construct A |
| 1224. | Cyno Cadherin-19 *Macaca fascicularis* |
| 1225. | secreted Cadherin-19 ecto-domain (amino acids 1-596) human |
| 1226. | ckCDH19(1-43)::FLAG::ckCDH19(44-776) construct J |
| 1227. | huCDH19(1-43)::FLAG::hu(44-141)::ckCDH19(142-776) construct K |
| 1228. | ckCDH19(1-43)::FLAG::ckCDH19(44-141) huCDH19(142-249)::ckCDH19(250-776):: construct L |
| 1229. | ckCDH19(1-43)::FLAG::ckCDH19(44-249)::huCDH19(250-364)::ckCDH19(365-776) construct M |
| 1230. | ckCDH19(1-43)::FLAG::ckCDH19(44-364)::huCDH19(365-463)::ckCDH19(469-776) construct N |
| 1231. | (1-43)::FLAG::ckCDH19(44-468)::huCDH19(464-772) construct O |

| | Sequence Table |
|---|---|
| 1232. | huCDH19(1-43)::FLAG::huCDH19(44-772) |
| 1233. | Human CD3E extracellular domain |
| 1234. | Human CD3ε 1-27 |
| 1235. | *Callithrix jacchus* CD3ε extracellular domain |
| 1236. | *Callithrix jacchus* CD3ε 1-27 |
| 1237. | *Saguinus oedipus* CD3ε extracellular domain |
| 1238. | *Saguinus oedipus* CD3ε 1-27 |
| 1239. | *Saimiri sciureus* CD3ε extracellular domain |
| 1240. | *Saimiri sciureus* CD3ε 1-27 |

SEQUENCE LISTING (1851 sequences)

SEQ ID NO: 1 - protein, 5 aa, Artificial Sequence
  Synthetic polypeptide
SYGMH

SEQ ID NO: 2 - protein, 17 aa, Artificial Sequence
  Synthetic polypeptide
FIWYDGSNKYYADSVKG

SEQ ID NO: 3 - protein, 16 aa, Artificial Sequence
  Synthetic polypeptide
RAGIIGTIGYYYGMDV

SEQ ID NO: 4 - protein, 11 aa, Artificial Sequence
  Synthetic polypeptide
SGDRLGEKYTS

SEQ ID NO: 5 - protein, 7 aa, Artificial Sequence
  Synthetic polypeptide
QDTKRPS

SEQ ID NO: 6 - protein, 9 aa, Artificial Sequence
  Synthetic polypeptide
QAWESSTVV

SEQ ID NO: 7 - DNA, 375 bp, Artificial Sequence
  Synthetic polynucleotide
caggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaagggccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 8 - protein, 125 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSS

SEQ ID NO: 9 - DNA, 318 bp, Artificial Sequence
  Synthetic polynucleotide
tcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 10 - protein, 106 aa, Artificial Sequence
  Synthetic polypeptide
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 11 - DNA, 738 bp, Artificial Sequence
  Synthetic polynucleotide
caggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaagggccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggaggcggaggatctggtggcggtggttctggcggcggaggctcctcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 12 - protein, 246 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 13 - protein, 507 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 14 - protein, 7 aa, Artificial Sequence
  Synthetic polypeptide
RGGYYWS

SEQ ID NO: 15 - protein, 16 aa, Artificial Sequence
  Synthetic polypeptide
YIFYRGRTYYNPSLKS

SEQ ID NO: 16 - protein, 10 aa, Artificial Sequence
  Synthetic polypeptide
VNSNYGWFDP

SEQ ID NO: 17 - protein, 12 aa, Artificial Sequence
  Synthetic polypeptide
RASQSVSSSYLA

SEQ ID NO: 18 - protein, 7 aa, Artificial Sequence
  Synthetic polypeptide
GASSRAT

SEQ ID NO: 19 - protein, 9 aa, Artificial Sequence
  Synthetic polypeptide
QQYGSSPLT

SEQ ID NO: 20 - DNA, 360 bp, Artificial Sequence
  Synthetic polynucleotide
caggtgcagctgcaggagtcgggcccaggactggtgaagccttcacagaccctgtccctcacctgcactgtctctggtggctccatcagcaggggtggttactactggagctggatccgccagcacccagggaagggcctggagtggattggatacatcttttacagggggagaacctattataatccgtccctcaagagtcgagttaccatatcagtagacacgtctaagaaccagttctccctgaagctgagctctgtgactgccgcggacacggccgtgtactactgtgcgagagtaaacagtaactacgggtggttcgacccctggggccagggaaccctggtcaccgtctcctca

SEQ ID NO: 21 - protein, 120 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSS

SEQ ID NO: 22 - DNA, 324 bp, Artificial Sequence
  Synthetic polynucleotide
gagatcgttctcacgcagtttccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctcactttcggcggagggaccaagctggagatcaaa

SEQ ID NO: 23 - protein, 108 aa, Artificial Sequence
  Synthetic polypeptide
EIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 24 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcaggggtggttactactggagctggatccgccagcacccagggaagggcctggagtggattggatacatcttttacagggggagaacctattataatccgtccctcaagagtcgagttaccatatcagtagacacgtctaagaaccagttctccctgaagctgagctctgtgactgccgcggacacggccgtgtactactgtgcgagagtaaacagtaactacgggtggttcgacccctggggccagggaaccctggtcaccgtctcctcaggtggtggtggttctggcggcggcggctccggtggtggtggttctgagatcgttctcacgcagtttccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctcactttcggcggagggaccaagctggagatcaaa

SEQ ID NO: 25 - protein, 243 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 26 - protein, 504 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 27 - protein, 7 aa, Artificial Sequence
  Synthetic polypeptide
SGGYYWS

SEQ ID NO: 28 - protein, 16 aa, Artificial Sequence
  Synthetic polypeptide
YIFYRGRTYYNPSLKS

SEQ ID NO: 29 - protein, 10 aa, Artificial Sequence
  Synthetic polypeptide
VYSNYGWFDP

SEQ ID NO: 30 - protein, 12 aa, Artificial Sequence
  Synthetic polypeptide
RASQSVSSSYLA

SEQ ID NO: 31 - protein, 7 aa, Artificial Sequence
  Synthetic polypeptide
GTSNRAT

SEQ ID NO: 32 - protein, 9 aa, Artificial Sequence
  Synthetic polypeptide
QQYGSSPLT

SEQ ID NO: 33 - DNA, 360 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttaccgtgggagaacctactacaacccgtccctcaagagtcgagttaccatttcagtagacacgtctaagaaccagttctccctgaagctgagctctgtgactgccgcggacacggccgtgtattactgtgcgagagtctacagtaactacgggtggttcgacccctggggccagggaaccctggtcaccgtctcctca

SEQ ID NO: 34 - protein, 120 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSS

SEQ ID NO: 35 - DNA, 324 bp, Artificial Sequence
  Synthetic polynucleotide
gagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtacatccaacagggccactggcatcccagacaggttcagtggcagtgggtctgggacagacttcactctcaccatcagcagactggagcctgaagattttgcagtgtattactgtcagcagtatggtagctcacctctcactttcggcggagggaccaagctggagatcaaa

SEQ ID NO: 36 - protein, 108 aa, Artificial Sequence
  Synthetic polypeptide
EIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIK

SEQ ID NO: 37 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttaccgtgggagaacctactacaacccgtccctcaagagtcgagttaccatttcagtagacacgtctaagaaccagttctccctgaagctgagctctgtgactgccgcggacacggccgtgtattactgtgcgagagtctacagtaactacgggtggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtacatccaacagggccactggcatcccagacaggttcagtggcagtgggtctgggacagacttcactctcaccatcagcagactggagcctgaagattttgcagtgtattactgtcagcagtatggtagctcacctctcactttcggcggagggaccaagctggagatcaaa

SEQ ID NO: 38 - protein, 243 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIK

SEQ ID NO: 39 - protein, 504 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 40 - protein, 7 aa, Artificial Sequence
  Synthetic polypeptide
SGGYYWS

SEQ ID NO: 41 - protein, 16 aa, Artificial Sequence
  Synthetic polypeptide
YIFYSGRTYYNPSLKS

SEQ ID NO: 42 - protein, 10 aa, Artificial Sequence
  Synthetic polypeptide
VYSNYGWFDP

SEQ ID NO: 43 - protein, 12 aa, Artificial Sequence
  Synthetic polypeptide
RASQSVSSSYLA

SEQ ID NO: 44 - protein, 7 aa, Artificial Sequence
  Synthetic polypeptide
GASSRAT

SEQ ID NO: 45 - protein, 9 aa, Artificial Sequence
  Synthetic polypeptide
QQYGSSPLT

SEQ ID NO: 46 - DNA, 360 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttacagtgggaggacctactacaacccgtccctcaagagtcgagttaccatatcagtagacacgtctaagaaccagttctccctgaagctgagctctgtgactgccgcggacacggccgtgtattactgtgcgagagtctacagtaactacggatggttcgacccctggggccagggaaccctggtcaccgtctcctca

SEQ ID NO: 47 - protein, 120 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSS

SEQ ID NO: 48 - DNA, 324 bp, Artificial Sequence
  Synthetic polynucleotide
gagatcgttttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaagctggagatcaaa

SEQ ID NO: 49 - protein, 108 aa, Artificial Sequence
  Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 50 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttacagtgggaggacctactacaacccgtccctcaagagtcgagttaccatatcagtagacacgtctaagaaccagttctccctgaagctgagctctgtgactgccgcggacacggccgtgtattactgtgcgagagtctacagtaactacggatggttcgacccctggggccagggaaccctggtcaccgtctcctcaggtggtggtggttctggcggcggcggctccggtggtggtggttctgagatcgttttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaagctggagatcaaa

SEQ ID NO: 51 - protein, 243 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 52 - protein, 504 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 53 - protein, 7 aa, Artificial Sequence
  Synthetic polypeptide
SGGYYWS

SEQ ID NO: 54 - protein, 16 aa, Artificial Sequence
  Synthetic polypeptide
YIFYSGRTYYNPSLKS

SEQ ID NO: 55 - protein, 10 aa, Artificial Sequence
  Synthetic polypeptide
VYSNYGWFDP

SEQ ID NO: 56 - protein, 12 aa, Artificial Sequence
  Synthetic polypeptide
RASQSVSSSYLA

SEQ ID NO: 57 - protein, 7 aa, Artificial Sequence
  Synthetic polypeptide
GASSRAT

SEQ ID NO: 58 - protein, 9 aa, Artificial Sequence
  Synthetic polypeptide
QQYGSSPLT

SEQ ID NO: 59 - DNA, 360 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccaacacccagggaagggcctggagtggattgggtacatcttttacagtgggaggacctactacaacccgtccctcaagagtcgagttaccatatcagtagacacgtctaagaaccagttctccctgaagctgcgctctgtgactgccgcggacacggccgtgtattactgtgcgagagtctacagtaactacggatggttcgacccctggggccagggaaccctggtcaccgtctcctca

SEQ ID NO: 60 - protein, 120 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSS

SEQ ID NO: 61 - DNA, 324 bp, Artificial Sequence; identical to SEQ ID NO: 48
  Synthetic polynucleotide

SEQ ID NO: 62 - protein, 108 aa, Artificial Sequence; identical to SEQ ID NO: 49
  Synthetic polypeptide

SEQ ID NO: 63 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccaacacccagggaagggcctggagtggattgggtacatcttttacagtgggaggacctactacaacccgtccctcaagagtcgagttaccatatcagtagacacgtctaagaaccagttctccctgaagctgcgctctgtgactgccgcggacacggccgtgtattactgtgcgagagtctacagtaactacggatggttcgacccctggggccagggaaccctggtcaccgtctcctcaggtggtggtggttctggcggcggcggctccggtggtggtggttctgagatcgttttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaagctggagatcaaa

SEQ ID NO: 64 - protein, 243 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 65 - protein, 504 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 66 - protein, 7 aa, Artificial Sequence
  Synthetic polypeptide
SGGYYWS

SEQ ID NO: 67 - protein, 16 aa, Artificial Sequence
  Synthetic polypeptide
YIYYSGSTFYNPSLRS

SEQ ID NO: 68 - protein, 10 aa, Artificial Sequence
  Synthetic polypeptide
DSSSSRALDY

SEQ ID NO: 69 - protein, 12 aa, Artificial Sequence
  Synthetic polypeptide
RASQSVSSSYLA

SEQ ID NO: 70 - protein, 7 aa, Artificial Sequence
  Synthetic polypeptide
GASSRAT

SEQ ID NO: 71 - protein, 9 aa, Artificial Sequence
  Synthetic polypeptide
QQYDSSPRT

SEQ ID NO: 72 - DNA, 360 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcaccttctacaatccgtccctcaggagtcgagttaccatatcagtagacacgtctaagaaccagttctccctgaagctgagctctgtgactgccgcggacacggccgtgtactactgtgcgagagatagtagttcgtcccgggcacttgactactggggccagggaaccctggtcaccgtctcctca

SEQ ID NO: 73 - protein, 120 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSS

SEQ ID NO: 74 - DNA, 324 bp, Artificial Sequence
  Synthetic polynucleotide
gagatcgttttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatgatagctcacctcgaacgttcggccaagggaccaagctggagatcaaa

SEQ ID NO: 75 - protein, 108 aa, Artificial Sequence
  Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIK

SEQ ID NO: 76 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcaccttctacaatccgtccctcaggagtcgagttaccatatcagtagacacgtctaagaaccagttctccctgaagctgagctctgtgactgccgcggacacggccgtgtactactgtgcgagagatagtagttcgtcccgggcacttgactactggggccagggaaccctggtcaccgtctcctcaggtggtggtggttctggcggcggcggctccggtggtggtggttctgagatcgttttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatgatagctcacctcgaacgttcggccaagggaccaagctggagatcaaa

SEQ ID NO: 77 - protein, 243 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIK

SEQ ID NO: 78 - protein, 504 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 79 - protein, 7 aa, Artificial Sequence
  Synthetic polypeptide
SGGYYWS

SEQ ID NO: 80 - protein, 16 aa, Artificial Sequence
  Synthetic polypeptide
YIYYRGRTYYNPSLKS

SEQ ID NO: 81 - protein, 10 aa, Artificial Sequence
  Synthetic polypeptide
VYSNYGWFDP

SEQ ID NO: 82 - protein, 12 aa, Artificial Sequence
  Synthetic polypeptide
RASQSVSSSYLA

SEQ ID NO: 83 - protein, 7 aa, Artificial Sequence
  Synthetic polypeptide
GASSRAT

SEQ ID NO: 84 - protein, 9 aa, Artificial Sequence
  Synthetic polypeptide
QQYGSSPLT

SEQ ID NO: 85 - DNA, 360 bp, Artificial Sequence
  Synthetic polynucleotide
caggtgcagctgcaggagtcgggcccaggactggtgaagccttcacagaccctgtccctcacctgcacagtctctggtggctccatcagcagtggtggttactactggagctggatccgccagcacccagggaagggcctggagtggattggatacatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctca

SEQ ID NO: 86 - protein, 120 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSS

SEQ ID NO: 87 - DNA, 324 bp, Artificial Sequence; identical to SEQ ID NO: 48
  Synthetic polynucleotide

SEQ ID NO: 88 - protein, 108 aa, Artificial Sequence; identical to SEQ ID NO: 49
  Synthetic polypeptide

SEQ ID NO: 89 - DNA, 729 bp, Artificial Sequence
  Synthetic polynucleotide
caggtgcagctgcaggagtcgggcccaggactggtgaagccttcacagaccctgtccctcacctgcacagtctctggtggctccatcagcagtggtggttactactggagctggatccgccagcacccagggaagggcctggagtggattggatacatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctcaggtggtggtggttctggcggcggcggctccggtggtggtggttctgagatcgttttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaagctggagatcaaa

SEQ ID NO: 90 - protein, 243 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 91 - protein, 504 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 92 - protein, 7 aa, Artificial Sequence
  Synthetic polypeptide
SGGYYWS

SEQ ID NO: 93 - protein, 16 aa, Artificial Sequence
  Synthetic polypeptide
YIFYRGRTYYNPSLKS

SEQ ID NO: 94 - protein, 10 aa, Artificial Sequence
  Synthetic polypeptide
VYSNYGWFDP

SEQ ID NO: 95 - protein, 12 aa, Artificial Sequence
  Synthetic polypeptide
RASQSVSSSYLA

SEQ ID NO: 96 - protein, 7 aa, Artificial Sequence
  Synthetic polypeptide
GASSRAT

SEQ ID NO: 97 - protein, 8 aa, Artificial Sequence
  Synthetic polypeptide
QQYGSSPT

SEQ ID NO: 98 - DNA, 360 bp, Artificial Sequence
  Synthetic polynucleotide
caggtgcagctgcaggagtcgggcccaggactggtgaagccttcggagaccctgtccctcacctgcactgtctctggtggctccatcagcagtggtggttactactggagctggatccgccagcacccagggaagggcctggagtggattgggtacatcttttaccgtgggagaacctactacaacccgtccctcaagagtcgagttaccatttcagtagacacgtctaagaaccagttctccctgaagctgagctctgtgactgccgcggacacggccgtgtattactgtgcgagagtctacagtaactacgggtggttcgacccctggggccagggaaccctggtcaccgtctcctca

SEQ ID NO: 99 - protein, 120 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSS

SEQ ID NO: 100 - DNA, 321 bp, Artificial Sequence
  Synthetic polynucleotide
gagatcgttttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccactttcggcggagggaccaaggtggagatcaaa

SEQ ID NO: 101 - protein, 107 aa, Artificial Sequence
  Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 102 - DNA, 726 bp, Artificial Sequence
  Synthetic polynucleotide
caggtgcagctgcaggagtcgggcccaggactggtgaagccttcggagaccctgtccctcacctgcactgtctctggtggctccatcagcagtggtggttactactggagctggatccgccagcacccagggaagggcctggagtggattgggtacatcttttaccgtgggagaacctactacaacccgtccctcaagagtcgagttaccatttcagtagacacgtctaagaaccagttctccctgaagctgagctctgtgactgccgcggacacggccgtgtattactgtgcgagagtctacagtaactacgggtggttcgacccctggggccagggaaccctggtcaccgtctcctcaggtggtggtggttctggcggcggcggctccggtggtggtggttctgagatcgttttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccactttcggcggagggaccaaggtggagatcaaa

SEQ ID NO: 103 - protein, 242 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 104 - protein, 503 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 105 - protein, 7 aa, Artificial Sequence
  Synthetic polypeptide
SGGYYWS

SEQ ID NO: 106 - protein, 16 aa, Artificial Sequence
  Synthetic polypeptide
YIFYRGRTYYNPSLKS

SEQ ID NO: 107 - protein, 10 aa, Artificial Sequence
  Synthetic polypeptide
VYSNYGWFDP

SEQ ID NO: 108 - protein, 12 aa, Artificial Sequence
  Synthetic polypeptide
RASQSVSSSYLA

SEQ ID NO: 109 - protein, 7 aa, Artificial Sequence
  Synthetic polypeptide
GASSRAT

SEQ ID NO: 110 - protein, 9 aa, Artificial Sequence
  Synthetic polypeptide
QQYGSSPLT

SEQ ID NO: 111 - DNA, 360 bp, Artificial Sequence; identical to SEQ ID NO: 33
  Synthetic polynucleotide

SEQ ID NO: 112 - protein, 120 aa, Artificial Sequence; identical to SEQ ID NO: 34
  Synthetic polypeptide

SEQ ID NO: 113 - DNA, 324 bp, Artificial Sequence
  Synthetic polynucleotide
gagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggaaatcaaa

SEQ ID NO: 114 - protein, 108 aa, Artificial Sequence
  Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 115 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttaccgtgggagaacctactacaacccgtccctcaagagtcgagttaccatttcagtagacacgtctaagaaccagttctccctgaagctgagctctgtgactgccgcggacacggccgtgtattactgtgcgagagtctacagtaactacgggtggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggaaatcaaa

SEQ ID NO: 116 - protein, 243 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 117 - protein, 504 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 118 - protein, 7 aa, Artificial Sequence
  Synthetic polypeptide
SGGYYWS

SEQ ID NO: 119 - protein, 16 aa, Artificial Sequence
  Synthetic polypeptide
YIYYRGRTYYNPSLKS

SEQ ID NO: 120 - protein, 10 aa, Artificial Sequence
  Synthetic polypeptide
VYSNYGWFDP

SEQ ID NO: 121 - protein, 12 aa, Artificial Sequence
  Synthetic polypeptide
RASQSVSSSYLA

SEQ ID NO: 122 - protein, 7 aa, Artificial Sequence
  Synthetic polypeptide
GASSRAT

SEQ ID NO: 123 - protein, 8 aa, Artificial Sequence
  Synthetic polypeptide
QQYGSSPT

SEQ ID NO: 124 - DNA, 360 bp, Artificial Sequence
  Synthetic polynucleotide
caggtgcagctgcaggagtcgggcccaggactggtgaagccttcacagaccctgtccctcacctgcacagtctctggtggctccatcagcagtggtggttactactggagctggatccgccagcacccagggaagggcctggagtggattgggtacatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctca

SEQ ID NO: 125 - protein, 120 aa, Artificial Sequence; identical to SEQ ID NO: 86
  Synthetic polypeptide

SEQ ID NO: 126 - DNA, 321 bp, Artificial Sequence
  Synthetic polynucleotide
gagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccactttcggccctgggaccaaggtggagatcaaa

SEQ ID NO: 127 - protein, 107 aa, Artificial Sequence
  Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIK

SEQ ID NO: 128 - DNA, 726 bp, Artificial Sequence
  Synthetic polynucleotide
caggtgcagctgcaggagtcgggcccaggactggtgaagccttcacagaccctgtccctcacctgcacagtctctggtggctccatcagcagtggtggttactactggagctggatccgccagcacccagggaagggcctggagtggattgggtacatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccactttcggccctgggaccaaggtggagatcaaa

SEQ ID NO: 129 - protein, 242 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIK

SEQ ID NO: 130 - protein, 503 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 131 - protein, 7 aa, Artificial Sequence
  Synthetic polypeptide
SGGYYWS

SEQ ID NO: 132 - protein, 16 aa, Artificial Sequence
  Synthetic polypeptide
YIYYRGRTYYNPSLKS

SEQ ID NO: 133 - protein, 10 aa, Artificial Sequence
  Synthetic polypeptide
VYSNYGWFDP

SEQ ID NO: 134 - protein, 12 aa, Artificial Sequence
  Synthetic polypeptide
RASQSVSSSYLA

SEQ ID NO: 135 - protein, 7 aa, Artificial Sequence
  Synthetic polypeptide
GASSRAT

SEQ ID NO: 136 - protein, 8 aa, Artificial Sequence
  Synthetic polypeptide
QQYGSSPT

SEQ ID NO: 137 - DNA, 360 bp, Artificial Sequence; identical to SEQ ID NO: 124
  Synthetic polynucleotide

SEQ ID NO: 138 - protein, 120 aa, Artificial Sequence; identical to SEQ ID NO: 86
  Synthetic polypeptide

SEQ ID NO: 139 - DNA, 321 bp, Artificial Sequence
  Synthetic polynucleotide
gagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccactttcggcggagggaccaaggtggagatcaaa

SEQ ID NO: 140 - protein, 107 aa, Artificial Sequence; identical to SEQ ID NO: 101
  Synthetic polypeptide

SEQ ID NO: 141 - DNA, 726 bp, Artificial Sequence
  Synthetic polynucleotide
caggtgcagctgcaggagtcgggcccaggactggtgaagccttcacagaccctgtccctcacctgcacagtctctggtggctccatcagcagtggtggttactactggagctggatccgccagcacccagggaagggcctggagtggattgggtacatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccactttcggcggagggaccaaggtggagatcaaa

SEQ ID NO: 142 - protein, 242 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 143 - protein, 503 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 144 - protein, 7 aa, Artificial Sequence
  Synthetic polypeptide
SGGYYWS

SEQ ID NO: 145 - protein, 16 aa, Artificial Sequence
  Synthetic polypeptide
YIFYSGRTYYNPSLKS

SEQ ID NO: 146 - protein, 10 aa, Artificial Sequence
  Synthetic polypeptide
VNSNYGWFDP

SEQ ID NO: 147 - protein, 12 aa, Artificial Sequence
  Synthetic polypeptide
RASQSVSSSYLA

SEQ ID NO: 148 - protein, 7 aa, Artificial Sequence
  Synthetic polypeptide
GASSRAT

SEQ ID NO: 149 - protein, 8 aa, Artificial Sequence
  Synthetic polypeptide
QQYGSSPT

SEQ ID NO: 150 - DNA, 360 bp, Artificial Sequence
  Synthetic polynucleotide
caggtgcagctgcaggagtcgggcccaggactggtgaagccttcacagaccctgtccctcacctgcactatctctggtggctccatcagcagtggtggttactactggagctggatccgccagcacccagggaagggcctggagtggattgggtacatcttttacagtgggagaacctactacaacccgtccctcaagagtcgagttaccatatcagtagacacgtctaagaaccagttctccctgaagctgacctctgtgactgccgcggacacggccgtgtattactgtgcgagagtaaacagtaactacgggtggttcgacccctggggccagggaaccctggtcaccgtctcctca

SEQ ID NO: 151 - protein, 120 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSS

SEQ ID NO: 152 - DNA, 321 bp, Artificial Sequence
  Synthetic polynucleotide
gagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctactttcggcggagggaccaaggtggagatcaaa

SEQ ID NO: 153 - protein, 107 aa, Artificial Sequence; identical to SEQ ID NO: 101
  Synthetic polypeptide

SEQ ID NO: 154 - DNA, 726 bp, Artificial Sequence
  Synthetic polynucleotide
caggtgcagctgcaggagtcgggcccaggactggtgaagccttcacagaccctgtccctcacctgcactatctctggtggctccatcagcagtggtggttactactggagctggatccgccagcacccagggaagggcctggagtggattgggtacatcttttacagtgggagaacctactacaacccgtccctcaagagtcgagttaccatatcagtagacacgtctaagaaccagttctccctgaagctgacctctgtgactgccgcggacacggccgtgtattactgtgcgagagtaaacagtaactacgggtggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctactttcggcggagggaccaaggtggagatcaaa

SEQ ID NO: 155 - protein, 242 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 156 - protein, 503 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 157 - protein, 7 aa, Artificial Sequence
  Synthetic polypeptide
SGGYYWS

SEQ ID NO: 158 - protein, 16 aa, Artificial Sequence
  Synthetic polypeptide
YIFYRGRTYYNPSLKS

SEQ ID NO: 159 - protein, 10 aa, Artificial Sequence
  Synthetic polypeptide
VNSNYGWFDP

SEQ ID NO: 160 - protein, 12 aa, Artificial Sequence
  Synthetic polypeptide
RASQSVSSSYLA

SEQ ID NO: 161 - protein, 7 aa, Artificial Sequence
  Synthetic polypeptide
GASSRAT

SEQ ID NO: 162 - protein, 9 aa, Artificial Sequence
  Synthetic polypeptide
QQYGSSPLT

SEQ ID NO: 163 - DNA, 360 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggactggattggatacatcttttacagggggagaacctattataatccgtccctcaagagtcgagttaccatatcagtagacacgtctaagaaccagttctccctgaagctgagctctgtgactgccgcggacacggccgtgtactactgtgcgagagtaaacagtaactacgggtggttcgacccctggggccagggaaccctggtcaccgtctcctca

SEQ ID NO: 164 - protein, 120 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSS

SEQ ID NO: 165 - DNA, 324 bp, Artificial Sequence
  Synthetic polynucleotide
gagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaa

SEQ ID NO: 166 - protein, 108 aa, Artificial Sequence; identical to SEQ ID NO: 114
  Synthetic polypeptide

SEQ ID NO: 167 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggactggattggatacatcttttacagggggagaacctattataatccgtccctcaagagtcgagttaccatatcagtagacacgtctaagaaccagttctccctgaagctgagctctgtgactgccgcggacacggccgtgtactactgtgcgagagtaaacagtaactacgggtggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaa

SEQ ID NO: 168 - protein, 243 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 169 - protein, 504 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 170 - protein, 7 aa, Artificial Sequence
  Synthetic polypeptide
SGGYYWS

SEQ ID NO: 171 - protein, 16 aa, Artificial Sequence
  Synthetic polypeptide
YIYYRGRTYYNPSLKS

SEQ ID NO: 172 - protein, 10 aa, Artificial Sequence
  Synthetic polypeptide
VYSNYGWFDP

SEQ ID NO: 173 - protein, 12 aa, Artificial Sequence
  Synthetic polypeptide
RASQSVSSSYLA

SEQ ID NO: 174 - protein, 7 aa, Artificial Sequence
  Synthetic polypeptide
GASTRAT

SEQ ID NO: 175 - protein, 8 aa, Artificial Sequence
  Synthetic polypeptide
QQYGSSPS

SEQ ID NO: 176 - DNA, 360 bp, Artificial Sequence; identical to SEQ ID NO: 124
  Synthetic polynucleotide

SEQ ID NO: 177 - protein, 120 aa, Artificial Sequence; identical to SEQ ID NO: 86
  Synthetic polypeptide

SEQ ID NO: 178 - DNA, 321 bp, Artificial Sequence
  Synthetic polynucleotide
gagatcgttttgacgcagtctccaggcaccctgtctttgtctccaggggaaagagccaccctctcctgcagggccagtcagagtgttagcagcagctatttagcctggtaccagcagaaacctggccaggctcccaggctcctcatctatggtgcatccaccagggccactggcatcccagacaggttcagtggcagtgggtctgggacagacttcactctcaccatcagcagactggagcctgaagattttgcagtgtattactgtcagcagtatggtagctcacctagttttggccaggggaccaaggtggaaatcaaa

SEQ ID NO: 179 - protein, 107 aa, Artificial Sequence
  Synthetic polypeptide
EIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIK

SEQ ID NO: 180 - DNA, 726 bp, Artificial Sequence
  Synthetic polynucleotide
caggtgcagctgcaggagtcgggcccaggactggtgaagccttcacagaccctgtccctcacctgcacagtctctggtggctccatcagcagtggtggttactactggagctggatccgccagcacccagggaagggcctggagtggattgggtacatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctcaggtggtggtggttctggcggcggcggctccggtggtggtggttctgagatcgttttgacgcagtctccaggcaccctgtctttgtctccaggggaaagagccaccctctcctgcagggccagtcagagtgttagcagcagctatttagcctggtaccagcagaaacctggccaggctcccaggctcctcatctatggtgcatccaccagggccactggcatcccagacaggttcagtggcagtgggtctgggacagacttcactctcaccatcagcagactggagcctgaagattttgcagtgtattactgtcagcagtatggtagctcacctagttttggccaggggaccaaggtggaaatcaaa

SEQ ID NO: 181 - protein, 242 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIK

SEQ ID NO: 182 - protein, 503 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 183 - protein, 7 aa, Artificial Sequence
  Synthetic polypeptide
SGGYYWS

SEQ ID NO: 184 - protein, 16 aa, Artificial Sequence
  Synthetic polypeptide
YIYYRGRTYYNPSLKS

SEQ ID NO: 185 - protein, 10 aa, Artificial Sequence
  Synthetic polypeptide
VYSNYGWFDP

SEQ ID NO: 186 - protein, 12 aa, Artificial Sequence
  Synthetic polypeptide
RASQSVSSSYLA

SEQ ID NO: 187 - protein, 7 aa, Artificial Sequence
  Synthetic polypeptide
GASSRAT

SEQ ID NO: 188 - protein, 9 aa, Artificial Sequence
  Synthetic polypeptide
QQYDTSPLT

SEQ ID NO: 189 - DNA, 360 bp, Artificial Sequence
  Synthetic polynucleotide
caggtgcagctgcaggagtcgggcccaggactggtgaggccttcacagaccctgtccctcacctgcacagtctctggtggctccatcagcagtggtggttactactggagctggatccgccagcacccagggaagggcctggagtggattgggtacatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctca

SEQ ID NO: 190 - protein, 120 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSS

SEQ ID NO: 191 - DNA, 324 bp, Artificial Sequence
  Synthetic polynucleotide
gagatcgttttgacgcagtctccaggcaccctgtctttgtctccaggagaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatgatacctcaccgctcactttcggcggagggaccaaggtggagatcaaa

SEQ ID NO: 192 - protein, 108 aa, Artificial Sequence
  Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIK

SEQ ID NO: 193 - DNA, 729 bp, Artificial Sequence
  Synthetic polynucleotide
caggtgcagctgcaggagtcgggcccaggactggtgaggccttcacagaccctgtccctcacctgcacagtctctggtggctccatcagcagtggtggttactactggagctggatccgccagcacccagggaagggcctggagtggattgggtacatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctcaggtggtggtggttctggcggcggcggctccggtggtggtggttctgagatcgttttgacgcagtctccaggcaccctgtctttgtctccaggagaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatgatacctcaccgctcactttcggcggagggaccaaggtggagatcaaa

SEQ ID NO: 194 - protein, 243 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIK

SEQ ID NO: 195 - protein, 504 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 196 - protein, 7 aa, Artificial Sequence
  Synthetic polypeptide
SGGYYWS

SEQ ID NO: 197 - protein, 16 aa, Artificial Sequence
  Synthetic polypeptide
YIYYRGRTYYNPSLKS

SEQ ID NO: 198 - protein, 10 aa, Artificial Sequence
  Synthetic polypeptide
VYSNYGWFDP

SEQ ID NO: 199 - protein, 12 aa, Artificial Sequence
  Synthetic polypeptide
RASQSVSSSYLA

SEQ ID NO: 200 - protein, 7 aa, Artificial Sequence
  Synthetic polypeptide
GASSRAT

SEQ ID NO: 201 - protein, 8 aa, Artificial Sequence
  Synthetic polypeptide
QQYGSSPT

SEQ ID NO: 202 - DNA, 360 bp, Artificial Sequence; identical to SEQ ID NO: 124
  Synthetic polynucleotide

SEQ ID NO: 203 - protein, 120 aa, Artificial Sequence; identical to SEQ ID NO: 86
  Synthetic polypeptide

SEQ ID NO: 204 - DNA, 321 bp, Artificial Sequence; identical to SEQ ID NO: 139
  Synthetic polynucleotide

SEQ ID NO: 205 - protein, 107 aa, Artificial Sequence; identical to SEQ ID NO: 101
  Synthetic polypeptide

SEQ ID NO: 206 - DNA, 726 bp, Artificial Sequence; identical to SEQ ID NO: 141
  Synthetic polynucleotide

SEQ ID NO: 207 - protein, 242 aa, Artificial Sequence; identical to SEQ ID NO: 142
  Synthetic polypeptide

SEQ ID NO: 208 - protein, 503 aa, Artificial Sequence; identical to SEQ ID NO: 143
  Synthetic polypeptide

SEQ ID NO: 209 - protein, 7 aa, Artificial Sequence
  Synthetic polypeptide
SGGYYWS

SEQ ID NO: 210 - protein, 16 aa, Artificial Sequence
  Synthetic polypeptide
YIYYRGRTYYNPSLKS

SEQ ID NO: 211 - protein, 10 aa, Artificial Sequence
  Synthetic polypeptide
VYSNYGWFDP

SEQ ID NO: 212 - protein, 12 aa, Artificial Sequence
  Synthetic polypeptide
RASQSVSSSYLA

SEQ ID NO: 213 - protein, 7 aa, Artificial Sequence
  Synthetic polypeptide
GASSRAT

SEQ ID NO: 214 - protein, 9 aa, Artificial Sequence
  Synthetic polypeptide
QQYGSSPLT

SEQ ID NO: 215 - DNA, 360 bp, Artificial Sequence; identical to SEQ ID NO: 124
  Synthetic polynucleotide

SEQ ID NO: 216 - protein, 120 aa, Artificial Sequence; identical to SEQ ID NO: 86
  Synthetic polypeptide

SEQ ID NO: 217 - DNA, 324 bp, Artificial Sequence; identical to SEQ ID NO: 113
  Synthetic polynucleotide

SEQ ID NO: 218 - protein, 108 aa, Artificial Sequence; identical to SEQ ID NO: 114
  Synthetic polypeptide

SEQ ID NO: 219 - DNA, 729 bp, Artificial Sequence
  Synthetic polynucleotide
caggtgcagctgcaggagtcgggcccaggactggtgaagccttcacagaccctgtccctcacctgcacagtctctggtggctccatcagcagtggtggttactactggagctggatccgccagcacccagggaagggcctggagtggattgggtacatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggaaatcaaa

SEQ ID NO: 220 - protein, 243 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 221 - protein, 504 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 222 - protein, 7 aa, Artificial Sequence
  Synthetic polypeptide
SGGYYWS

SEQ ID NO: 223 - protein, 16 aa, Artificial Sequence
  Synthetic polypeptide
YIFYSGRTYYNPSLKS

SEQ ID NO: 224 - protein, 10 aa, Artificial Sequence
  Synthetic polypeptide
VYSNYGWFDP

SEQ ID NO: 225 - protein, 12 aa, Artificial Sequence
  Synthetic polypeptide
RASQSVSSSYLA

SEQ ID NO: 226 - protein, 7 aa, Artificial Sequence
  Synthetic polypeptide
GASSRAT

SEQ ID NO: 227 - protein, 9 aa, Artificial Sequence
  Synthetic polypeptide
QQYGSSPLT

SEQ ID NO: 228 - DNA, 360 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctgggtccgccagcacccagggaagggcctggagtggattgggtacatcttttacagtgggaggacctactacaacccgtccctcaagagtcgagttatcatatcagtagacacgtctaagaaccagttctccctgaagctgagctctgtgactgccgcggacacggccgtgtattactgtgcgagagtctacagtaactacggatggttcgacccctggggccagggaaccctggtcaccgtctcctca

SEQ ID NO: 229 - protein, 120 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSS

SEQ ID NO: 230 - DNA, 324 bp, Artificial Sequence; identical to SEQ ID NO: 113
  Synthetic polynucleotide

SEQ ID NO: 231 - protein, 108 aa, Artificial Sequence; identical to SEQ ID NO: 114
  Synthetic polypeptide

SEQ ID NO: 232 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctgggtccgccagcacccagggaagggcctggagtggattgggtacatcttttacagtgggaggacctactacaacccgtccctcaagagtcgagttatcatatcagtagacacgtctaagaaccagttctccctgaagctgagctctgtgactgccgcggacacggccgtgtattactgtgcgagagtctacagtaactacggatggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggaaatcaaa

SEQ ID NO: 233 - protein, 243 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 234 - protein, 504 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 235 - protein, 7 aa, Artificial Sequence
  Synthetic polypeptide
SGGYYWS

SEQ ID NO: 236 - protein, 16 aa, Artificial Sequence
  Synthetic polypeptide
YIFYSGRTYYNPSLKS

SEQ ID NO: 237 - protein, 10 aa, Artificial Sequence
  Synthetic polypeptide
VYSNYGWFDP

SEQ ID NO: 238 - protein, 12 aa, Artificial Sequence
  Synthetic polypeptide
RASQSVSSSYLA

SEQ ID NO: 239 - protein, 7 aa, Artificial Sequence
  Synthetic polypeptide
GASSRAT

SEQ ID NO: 240 - protein, 9 aa, Artificial Sequence
  Synthetic polypeptide
QQYGSSPLT

SEQ ID NO: 241 - DNA, 360 bp, Artificial Sequence; identical to SEQ ID NO: 46
  Synthetic polynucleotide

SEQ ID NO: 242 - protein, 120 aa, Artificial Sequence; identical to SEQ ID NO: 47
  Synthetic polypeptide

SEQ ID NO: 243 - DNA, 324 bp, Artificial Sequence; identical to SEQ ID NO: 113
  Synthetic polynucleotide

SEQ ID NO: 244 - protein, 108 aa, Artificial Sequence; identical to SEQ ID NO: 114
  Synthetic polypeptide

SEQ ID NO: 245 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttacagtgggaggacctactacaacccgtccctcaagagtcgagttaccatatcagtagacacgtctaagaaccagttctccctgaagctgagctctgtgactgccgcggacacggccgtgtattactgtgcgagagtctacagtaactacggatggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggaaatcaaa

SEQ ID NO: 246 - protein, 243 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 247 - protein, 504 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 248 - protein, 7 aa, Artificial Sequence
  Synthetic polypeptide
SGGYYWS

SEQ ID NO: 249 - protein, 16 aa, Artificial Sequence
  Synthetic polypeptide
YIFYSGRTYYNPSLKS

SEQ ID NO: 250 - protein, 10 aa, Artificial Sequence
  Synthetic polypeptide
VYSNYGWFDP

SEQ ID NO: 251 - protein, 12 aa, Artificial Sequence
  Synthetic polypeptide
RASQSVSSSYLA

SEQ ID NO: 252 - protein, 7 aa, Artificial Sequence
  Synthetic polypeptide
GASSRAT

SEQ ID NO: 253 - protein, 9 aa, Artificial Sequence
  Synthetic polypeptide
QQYGSSPLT

SEQ ID NO: 254 - DNA, 360 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttacagtgggaggacctactacaacccgtccctcaagagtcgagtttccatatcagtagacacgtctaagaaccagttctccctgaagctgagctctgtgactgccgcggacacggccgtgtattactgtgcgagagtctacagtaactacggatggttcgacccctggggccagggaaccctggtcaccgtctcctca

SEQ ID NO: 255 - protein, 120 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSS

SEQ ID NO: 256 - DNA, 324 bp, Artificial Sequence
  Synthetic polynucleotide
gagatcgttttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtttattactgtcagcagtatggtagttcacctctcactttcggcggagggaccaaggtggaaatcaaa

SEQ ID NO: 257 - protein, 108 aa, Artificial Sequence; identical to SEQ ID NO: 114
  Synthetic polypeptide

SEQ ID NO: 258 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttacagtgggaggacctactacaacccgtccctcaagagtcgagtttccatatcagtagacacgtctaagaaccagttctccctgaagctgagctctgtgactgccgcggacacggccgtgtattactgtgcgagagtctacagtaactacggatggttcgacccctggggccagggaaccctggtcaccgtctcctcaggtggtggtggttctggcggcggcggctccggtggtggtggttctgagatcgttttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtttattactgtcagcagtatggtagttcacctctcactttcggcggagggaccaaggtggaaatcaaa

SEQ ID NO: 259 - protein, 243 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 260 - protein, 504 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 261 - protein, 7 aa, Artificial Sequence
  Synthetic polypeptide
SGGYYWS

SEQ ID NO: 262 - protein, 16 aa, Artificial Sequence
  Synthetic polypeptide
YIYYRGRTYYNPSLKS

SEQ ID NO: 263 - protein, 10 aa, Artificial Sequence
  Synthetic polypeptide
VYSNYGWFDP

SEQ ID NO: 264 - protein, 12 aa, Artificial Sequence
  Synthetic polypeptide
RASQSVSSSYLA

SEQ ID NO: 265 - protein, 7 aa, Artificial Sequence
  Synthetic polypeptide
GASSRAT

SEQ ID NO: 266 - protein, 9 aa, Artificial Sequence
  Synthetic polypeptide
QQYGSSPLT

SEQ ID NO: 267 - DNA, 360 bp, Artificial Sequence
  Synthetic polynucleotide
caggtgcagctgcaggagtcgggcccaggactggtgaagccttcggagaccctgtccctcacctgcactgtctctggtggctccgtcagcagtggtggttactactggagctggatccggcagcccccagggaagggactggagtggattgggtatatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctca

SEQ ID NO: 268 - protein, 120 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSS

SEQ ID NO: 269 - DNA, 324 bp, Artificial Sequence; identical to SEQ ID NO: 113
  Synthetic polynucleotide

SEQ ID NO: 270 - protein, 108 aa, Artificial Sequence; identical to SEQ ID NO: 114
  Synthetic polypeptide

SEQ ID NO: 271 - DNA, 729 bp, Artificial Sequence
  Synthetic polynucleotide
caggtgcagctgcaggagtcgggcccaggactggtgaagccttcggagaccctgtccctcacctgcactgtctctggtggctccgtcagcagtggtggttactactggagctggatccggcagcccccagggaagggactggagtggattgggtatatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggaaatcaaa

SEQ ID NO: 272 - protein, 243 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 273 - protein, 504 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 274 - protein, 7 aa, Artificial Sequence
  Synthetic polypeptide
SGGYYWS

SEQ ID NO: 275 - protein, 16 aa, Artificial Sequence
  Synthetic polypeptide
YIYYRGRTYYNPSLKS

SEQ ID NO: 276 - protein, 10 aa, Artificial Sequence
  Synthetic polypeptide
VYSNYGWFDP

SEQ ID NO: 277 - protein, 12 aa, Artificial Sequence
  Synthetic polypeptide
RASQSVSSSYLA

SEQ ID NO: 278 - protein, 7 aa, Artificial Sequence
  Synthetic polypeptide
GASSRAT

SEQ ID NO: 279 - protein, 8 aa, Artificial Sequence
  Synthetic polypeptide
QQYGSSPT

SEQ ID NO: 280 - DNA, 360 bp, Artificial Sequence; identical to SEQ ID NO: 124
  Synthetic polynucleotide

SEQ ID NO: 281 - protein, 120 aa, Artificial Sequence; identical to SEQ ID NO: 86
  Synthetic polypeptide

SEQ ID NO: 282 - DNA, 321 bp, Artificial Sequence
  Synthetic polynucleotide
gagatcgttctcacgcagtctccaggcaccctgtctttgtctccaggggaaagagccaccctctcctgcagggccagtcagagtgttagcagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaa

SEQ ID NO: 283 - protein, 107 aa, Artificial Sequence
  Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIK

SEQ ID NO: 284 - DNA, 726 bp, Artificial Sequence
  Synthetic polynucleotide
caggtgcagctgcaggagtcgggcccaggactggtgaagccttcacagaccctgtccctcacctgcacagtctctggtggctccatcagcagtggtggttactactggagctggatccgccagcacccagggaagggcctggagtggattgggtacatctattacagggggagaacctactacaacccgtccctcaagagtcgagttaccatatcagtagacacgtctaagaaccagttctccctgaagctgagctctgtgactgccgcggacacggccgtgtattactgtgcgagagtttacagtaactacggctggttcgacccctggggccagggaaccctggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaa

SEQ ID NO: 285 - protein, 242 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIK

SEQ ID NO: 286 - protein, 503 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 287 - protein, 7 aa, Artificial Sequence
  Synthetic polypeptide
SGGYYWS

SEQ ID NO: 288 - protein, 16 aa, Artificial Sequence
  Synthetic polypeptide
YIFYSGKTYYNPSLKS

SEQ ID NO: 289 - protein, 10 aa, Artificial Sequence
  Synthetic polypeptide
VYSNYGWFDP

SEQ ID NO: 290 - protein, 12 aa, Artificial Sequence
  Synthetic polypeptide
RASQSVSSSYLA

SEQ ID NO: 291 - protein, 7 aa, Artificial Sequence
  Synthetic polypeptide
GASSRAT

SEQ ID NO: 292 - protein, 9 aa, Artificial Sequence
  Synthetic polypeptide
QQYGSSPIT

SEQ ID NO: 293 - DNA, 360 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttacagtgggaagacctactataacccgtccctcaagagtcgagtttccatatcagtagacacgtctaagaaccagttctccctgaagctgagctctgtgactgccgcggacacggccgtgtattactgtgcgagagtctacagtaactacggatggttcgacccctggggccagggaaccctggtcaccgtctcctca

SEQ ID NO: 294 - protein, 120 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSS

SEQ ID NO: 295 - DNA, 324 bp, Artificial Sequence
  Synthetic polynucleotide
gagatcgttttgacacagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaa

SEQ ID NO: 296 - protein, 108 aa, Artificial Sequence
  Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIK

SEQ ID NO: 297 - DNA, 729 bp, Artificial Sequence
  Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttacagtgggaagacctactataacccgtccctcaagagtcgagtttccatatcagtagacacgtctaagaaccagttctccctgaagctgagctctgtgactgccgcggacacggccgtgtattactgtgcgagagtctacagtaactacggatggttcgacccctggggccagggaaccctggtcaccgtctcctcaggtggtggtggttctggcggcggcggctccggtggtggtggttctgagatcgttttgacacagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaa

SEQ ID NO: 298 - protein, 243 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIK

SEQ ID NO: 299 - protein, 504 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 300 - protein, 5 aa, Artificial Sequence
  Synthetic polypeptide
SYYWS

SEQ ID NO: 301 - protein, 16 aa, Artificial Sequence
  Synthetic polypeptide
YIYYSGSTNYNPSLKS

SEQ ID NO: 302 - protein, 17 aa, Artificial Sequence
  Synthetic polypeptide
DQRRIVAAGGYYYGMDV

SEQ ID NO: 303 - protein, 12 aa, Artificial Sequence
  Synthetic polypeptide
RASQSVSSSYLA

SEQ ID NO: 304 - protein, 7 aa, Artificial Sequence
  Synthetic polypeptide
GASTRAT

SEQ ID NO: 305 - protein, 9 aa, Artificial Sequence
  Synthetic polypeptide
QQYGSSPFT

SEQ ID NO: 306 - DNA, 375 bp, Artificial Sequence
  Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagtaccaactacaacccctccctcaagagtcgagtcaccatgtcaatagacacgtccaagaaccagttctccctgaagctgatctctgtgaccgctgcggacacggccgtatactactgtgccagagatcaaaggcgtatagtagcagctggggggtactactacggtatggacgtctggggccaagggaccacggtcaccgtctcctca

SEQ ID NO: 307 - protein, 125 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSS

SEQ ID NO: 308 - DNA, 324 bp, Artificial Sequence
  Synthetic polynucleotide
gagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccaccagggccactggtatcccagccaggttcagtggcagtgggtctgggacagacttcactctcaccatcagcagactggagcctgaagattttgcagtgtattactgtcagcagtatggtagctcaccattcactttcggccctgggaccaaagtggatatcaaa

SEQ ID NO: 309 - protein, 108 aa, Artificial Sequence
  Synthetic polypeptide
EIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIK

SEQ ID NO: 310 - DNA, 744 bp, Artificial Sequence
  Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagtaccaactacaacccctccctcaagagtcgagtcaccatgtcaatagacacgtccaagaaccagttctccctgaagctgatctctgtgaccgctgcggacacggccgtatactactgtgccagagatcaaaggcgtatagtagcagctggggggtactactacggtatggacgtctggggccaagggaccacggtcaccgtctcctcaggtggtggtggttctggcggcggcggctccggtggtggtggttctgagatcgttctcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccaccagggccactggtatcccagccaggttcagtggcagtgggtctgggacagacttcactctcaccatcagcagactggagcctgaagattttgcagtgtattactgtcagcagtatggtagctcaccattcactttcggccctgggaccaaagtggatatcaaa

SEQ ID NO: 311 - protein, 248 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIK

SEQ ID NO: 312 - protein, 509 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 313 - protein, 7 aa, Artificial Sequence
  Synthetic polypeptide
SNDYYWS

SEQ ID NO: 314 - protein, 16 aa, Artificial Sequence
  Synthetic polypeptide
YIYYSGSTFYNPSLKS

SEQ ID NO: 315 - protein, 10 aa, Artificial Sequence
  Synthetic polypeptide
GVYRTGAFDI

SEQ ID NO: 316 - protein, 11 aa, Artificial Sequence
  Synthetic polypeptide
RASQSISSYLN

SEQ ID NO: 317 - protein, 7 aa, Artificial Sequence
  Synthetic polypeptide
AASSLQS

SEQ ID NO: 318 - protein, 9 aa, Artificial Sequence
  Synthetic polypeptide
QQSYSTPQA

SEQ ID NO: 319 - DNA, 360 bp, Artificial Sequence
  Synthetic polynucleotide
caggtgcagctgcaggagtcgggccccggactggtgaagccttcacagaccctgtccctcacctgcactgtctctggtggctccatcagcagtaatgattactactggagctggatccgccagcacccagggaagggcctggagtggattgggtacatctattacagtgggagcaccttctacaacccgtccctcaagagtcgaggtgccatatcagtagacacgtctaagaaccagttctccctgaagctgacctctgtgactgccgcggacacggccgtgtattactgtgcgaggggggtatacaggacgggtgcttttgatatctggggccaagggacaatggtcaccgtctcctca

SEQ ID NO: 320 - protein, 120 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSS

SEQ ID NO: 321 - DNA, 321 bp, Artificial Sequence
  Synthetic polynucleotide
gacatccagatgactcagtctccatcctccctgtctgcatctgtaggagacagagtcaccatcacttgccgggcaagtcagagcattagcagctatttaaattggtatcagcagaaaccagggaaagcccctaagtccctgatctatgctgcatccagtttgcaaagtggggtcccatcaaagttcagcggcagtggatctgggacagatttcactctcaccatcagcagcctgcagcctgaagatattgcaacttactactgtcaacagagttacagtacccctcaggctttcggcggagggaccaaagtggatatcaaa

SEQ ID NO: 322 - protein, 107 aa, Artificial Sequence
  Synthetic polypeptide
DIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIK

SEQ ID NO: 323 - DNA, 726 bp, Artificial Sequence
  Synthetic polynucleotide
caggtgcagctgcaggagtcgggccccggactggtgaagccttcacagaccctgtccctcacctgcactgtctctggtggctccatcagcagtaatgattactactggagctggatccgccagcacccagggaagggcctggagtggattgggtacatctattacagtgggagcaccttctacaacccgtccctcaagagtcgaggtgccatatcagtagacacgtctaagaaccagttctccctgaagctgacctctgtgactgccgcggacacggccgtgtattactgtgcgaggggggtatacaggacgggtgcttttgatatctggggccaagggacaatggtcaccgtctcctcaggtggtggtggttctggcggcggcggctccggtggtggtggttctgacatccagatgactcagtctccatcctccctgtctgcatctgtaggagacagagtcaccatcacttgccgggcaagtcagagcattagcagctatttaaattggtatcagcagaaaccagggaaagcccctaagtccctgatctatgctgcatccagtttgcaaagtggggtcccatcaaagttcagcggcagtggatctgggacagatttcactctcaccatcagcagcctgcagcctgaagatattgcaacttactactgtcaacagagttacagtacccctcaggctttcggcggagggaccaaagtggatatcaaa

SEQ ID NO: 324 - protein, 242 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIK

SEQ ID NO: 325 - protein, 503 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 326 - protein, 5 aa, Artificial Sequence
  Synthetic polypeptide
YYGIS

SEQ ID NO: 327 - protein, 17 aa, Artificial Sequence
  Synthetic polypeptide
WINPYGGETNYAQKLQG

SEQ ID NO: 328 - protein, 7 aa, Artificial Sequence
  Synthetic polypeptide
GSGGFDY

SEQ ID NO: 329 - protein, 16 aa, Artificial Sequence
  Synthetic polypeptide
RSSQSLLHSNGYNYLD

SEQ ID NO: 330 - protein, 7 aa, Artificial Sequence
  Synthetic polypeptide
LGSYRAS

SEQ ID NO: 331 - protein, 9 aa, Artificial Sequence
  Synthetic polypeptide
MQALQTPFT

SEQ ID NO: 332 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttacggcggtgagacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctca

SEQ ID NO: 333 - protein, 116 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSS

SEQ ID NO: 334 - DNA, 336 bp, Artificial Sequence
  Synthetic polynucleotide
gacatcgtgatgacccagactccactctctctgtccgtcacccctggagagccggcctccatctcctgcaggtctagtcagagcctcctgcatagtaatggatacaactatttggattggtacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 335 - protein, 112 aa, Artificial Sequence
  Synthetic polypeptide
DIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIK

SEQ ID NO: 336 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttacggcggtgagacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgacccagactccactctctctgtccgtcacccctggagagccggcctccatctcctgcaggtctagtcagagcctcctgcatagtaatggatacaactatttggattggtacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 337 - protein, 243 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIK

SEQ ID NO: 338 - protein, 504 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 339 - protein, 5 aa, Artificial Sequence
  Synthetic polypeptide
YYGIS

SEQ ID NO: 340 - protein, 17 aa, Artificial Sequence
  Synthetic polypeptide
WINPYSGATNYAQKLQG

SEQ ID NO: 341 - protein, 7 aa, Artificial Sequence
  Synthetic polypeptide
GSGGFDY

SEQ ID NO: 342 - protein, 16 aa, Artificial Sequence
  Synthetic polypeptide
RSSQSLLHSNGYNYLD

SEQ ID NO: 343 - protein, 7 aa, Artificial Sequence
  Synthetic polypeptide
LGSYRAS

SEQ ID NO: 344 - protein, 9 aa, Artificial Sequence
  Synthetic polypeptide
MQALQTPFT

SEQ ID NO: 345 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttactccggtgcgacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctca

SEQ ID NO: 346 - protein, 116 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSS

SEQ ID NO: 347 - DNA, 336 bp, Artificial Sequence; identical to SEQ ID NO: 334
  Synthetic polynucleotide

SEQ ID NO: 348 - protein, 112 aa, Artificial Sequence; identical to SEQ ID NO: 335
  Synthetic polypeptide

SEQ ID NO: 349 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttactccggtgcgacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgacccagactccactctctctgtccgtcacccctggagagccggcctccatctcctgcaggtctagtcagagcctcctgcatagtaatggatacaactatttggattggtacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 350 - protein, 243 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIK

SEQ ID NO: 351 - protein, 504 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 352 - protein, 5 aa, Artificial Sequence
  Synthetic polypeptide
YYGIS

SEQ ID NO: 353 - protein, 17 aa, Artificial Sequence
  Synthetic polypeptide
WINPYTGKTNYAQKLQG

SEQ ID NO: 354 - protein, 7 aa, Artificial Sequence
  Synthetic polypeptide
GSGGFDY

SEQ ID NO: 355 - protein, 16 aa, Artificial Sequence
  Synthetic polypeptide
RSSQSLLHSNGYNYLD

SEQ ID NO: 356 - protein, 7 aa, Artificial Sequence
  Synthetic polypeptide
LGSYRAS

SEQ ID NO: 357 - protein, 9 aa, Artificial Sequence
  Synthetic polypeptide
MQALQTPFT

SEQ ID NO: 358 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttacaccggtaagacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctca

SEQ ID NO: 359 - protein, 116 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSS

SEQ ID NO: 360 - DNA, 336 bp, Artificial Sequence; identical to SEQ ID NO: 334
  Synthetic polynucleotide

SEQ ID NO: 361 - protein, 112 aa, Artificial Sequence; identical to SEQ ID NO: 335
  Synthetic polypeptide

SEQ ID NO: 362 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttacaccggtaagacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgacccagactccactctctctgtccgtcacccctggagagccggcctccatctcctgcaggtctagtcagagcctcctgcatagtaatggatacaactatttggattggtacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 363 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIK

SEQ ID NO: 364 - protein, 504 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 365 - protein, 5 aa, Artificial Sequence
  Synthetic polypeptide
YYGIS

SEQ ID NO: 366 - protein, 17 aa, Artificial Sequence
  Synthetic polypeptide
WINPYTGKTNYAQKLQG

SEQ ID NO: 367 - protein, 7 aa, Artificial Sequence
  Synthetic polypeptide
GSGGFDY

SEQ ID NO: 368 - protein, 16 aa, Artificial Sequence
  Synthetic polypeptide
RSSQSLLHSVGYNYLD

SEQ ID NO: 369 - protein, 7 aa, Artificial Sequence
  Synthetic polypeptide
LGSYRAS

SEQ ID NO: 370 - protein, 9 aa, Artificial Sequence
  Synthetic polypeptide
MQALQTPFT

SEQ ID NO: 371 - DNA, 348 bp, Artificial Sequence; identical to SEQ ID NO: 358
  Synthetic polynucleotide

SEQ ID NO: 372 - protein, 116 aa, Artificial Sequence; identical to SEQ ID NO: 359
  Synthetic polypeptide

SEQ ID NO: 373 - DNA, 336 bp, Artificial Sequence
  Synthetic polynucleotide
gacatcgtgatgacccagactccactctctctgtccgtcacccctggagagccggcctccatctcctgcaggtctagtcagagcctcctgcatagtgtgggatacaactatttggattggtacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 374 - protein, 112 aa, Artificial Sequence
  Synthetic polypeptide
DIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIK

SEQ ID NO: 375 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttacaccggtaagacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgacccagactccactctctctgtccgtcacccctggagagccggcctccatctcctgcaggtctagtcagagcctcctgcatagtgtgggatacaactatttggattggtacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 376 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIK

SEQ ID NO: 377 - protein, 504 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 378 - protein, 5 aa, Artificial Sequence
  Synthetic polypeptide
SYGIS

SEQ ID NO: 379 - protein, 17 aa, Artificial Sequence
  Synthetic polypeptide
WINPYTGNRNYAQKVQD

SEQ ID NO: 380 - protein, 7 aa, Artificial Sequence
  Synthetic polypeptide
GSGGFDY

SEQ ID NO: 381 - protein, 16 aa, Artificial Sequence
  Synthetic polypeptide
RSSQSLLHSVGYNYLD

SEQ ID NO: 382 - protein, 7 aa, Artificial Sequence
  Synthetic polypeptide
LGSNRAS

SEQ ID NO: 383 - protein, 9 aa, Artificial Sequence
  Synthetic polypeptide
MQALQTPFT

SEQ ID NO: 384 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttaccagctatggaatcagctgggtgcgacaggcccctggacaaggccttgagtggatgggatggatcaacccttataccggtaacagaaattatgcacagaaggtccaggacagagtcaccatgaccacagacacatccacgaacacagcctacatggagctgagcagcctgagatctgacgacacggccgtgtattactgtgcgagaggaagtgggggctttgactactggggccagggaaccctggtcaccgtctcctca

SEQ ID NO: 385 - protein, 116 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSS

SEQ ID NO: 386 - DNA, 336 bp, Artificial Sequence
  Synthetic polynucleotide
gacatcgtgatgactcagtctccactctccctgcccgtcacccttggacagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcaccttcggccctgggaccaagctggagatcaaa

SEQ ID NO: 387 - protein, 112 aa, Artificial Sequence
  Synthetic polypeptide
DIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIK

SEQ ID NO: 388 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttaccagctatggaatcagctgggtgcgacaggcccctggacaaggccttgagtggatgggatggatcaacccttataccggtaacagaaattatgcacagaaggtccaggacagagtcaccatgaccacagacacatccacgaacacagcctacatggagctgagcagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgactcagtctccactctccctgcccgtcacccttggacagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcaccttcggccctgggaccaagctggagatcaaa

SEQ ID NO: 389 - protein, 243 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIK

SEQ ID NO: 390 - protein, 504 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 391 - protein, 5 aa, Artificial Sequence
  Synthetic polypeptide
YYGIS

SEQ ID NO: 392 - protein, 17 aa, Artificial Sequence
  Synthetic polypeptide
WINPYTGKTNYAQKLQD

SEQ ID NO: 393 - protein, 7 aa, Artificial Sequence
  Synthetic polypeptide
GSGGFDY

SEQ ID NO: 394 - protein, 16 aa, Artificial Sequence
  Synthetic polypeptide
RSSQSLLHSVGYNYLD

SEQ ID NO: 395 - protein, 7 aa, Artificial Sequence
  Synthetic polypeptide
LGSNRAS

SEQ ID NO: 396 - protein, 9 aa, Artificial Sequence
  Synthetic polypeptide
MQALQTPFT

SEQ ID NO: 397 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttataccggtaagacaaactatgcacagaagctccaggacagagtcaccatgaccacagacacatccacgaacacagcctacatggagttgaggagcctgagatctgacgacacggccgtgtattactgtgcgagaggaagtgggggctttgactactggggccagggaaccctggtcaccgtctcctca

SEQ ID NO: 398 - protein, 116 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSS

SEQ ID NO: 399 - DNA, 336 bp, Artificial Sequence
  Synthetic polynucleotide
gacatcgtgatgacccagactccactctccctgcccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 400 - protein, 112 aa, Artificial Sequence
  Synthetic polypeptide
DIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 401 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttataccggtaagacaaactatgcacagaagctccaggacagagtcaccatgaccacagacacatccacgaacacagcctacatggagttgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgacccagactccactctccctgcccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 402 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 403 - protein, 504 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 404 - protein, 5 aa, Artificial Sequence
  Synthetic polypeptide
TYGIS

SEQ ID NO: 405 - protein, 17 aa, Artificial Sequence
  Synthetic polypeptide
WINPYTGKTNYAQKLQG

SEQ ID NO: 406 - protein, 7 aa, Artificial Sequence
  Synthetic polypeptide
GSGGFDY

SEQ ID NO: 407 - protein, 16 aa, Artificial Sequence
  Synthetic polypeptide
RSSQSLLHSVGYNYLD

SEQ ID NO: 408 - protein, 7 aa, Artificial Sequence
  Synthetic polypeptide
LGSNRAS

SEQ ID NO: 409 - protein, 9 aa, Artificial Sequence
  Synthetic polypeptide
MQALQTPFT

SEQ ID NO: 410 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttaccacctatggtatcagttgggtgcgacaggcccctggacaaggtcttgagtggatgggatggatcaacccttacaccggtaagacaaactatgcacagaagctccagggcagagtcaccatggccacagacacatccacgagcacagcctacatggagctgaggagcctgagatctgacgacacggccgtgtattactgtgcgagaggaagtgggggctttgactactggggccagggaaccctggtcaccgtctcctca

SEQ ID NO: 411 - protein, 116 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSS

SEQ ID NO: 412 - DNA, 336 bp, Artificial Sequence
  Synthetic polynucleotide
gacatcgtgatgactcagtctccactctccctgcccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaagctggagatcaaa

SEQ ID NO: 413 - protein, 112 aa, Artificial Sequence
  Synthetic polypeptide
DIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIK

SEQ ID NO: 414 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttaccacctatggtatcagttgggtgcgacaggcccctggacaaggtcttgagtggatgggatggatcaacccttacaccggtaagacaaactatgcacagaagctccagggcagagtcaccatggccacagacacatccacgagcacagcctacatggagctgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgactcagtctccactctccctgcccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaagctggagatcaaa

SEQ ID NO: 415 - protein, 243 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIK

SEQ ID NO: 416 - protein, 504 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 417 - protein, 5 aa, Artificial Sequence
  Synthetic polypeptide
YYGIS

SEQ ID NO: 418 - protein, 17 aa, Artificial Sequence
  Synthetic polypeptide
WINPYTGNRNYAQKVQD

SEQ ID NO: 419 - protein, 7 aa, Artificial Sequence
  Synthetic polypeptide
GSGGFDY

SEQ ID NO: 420 - protein, 16 aa, Artificial Sequence
  Synthetic polypeptide
RSSQSLLHSVGYNYLD

SEQ ID NO: 421 - protein, 7 aa, Artificial Sequence
  Synthetic polypeptide
LGSNRAS

SEQ ID NO: 422 - protein, 9 aa, Artificial Sequence
  Synthetic polypeptide
MQALQTPFT

SEQ ID NO: 423 - DNA, 348 bp, Artificial Sequence
  Synthetic polynucleotide
caggtgcagctggtccagtctggggctgaggtgaaggagcccggggcctcagtgaaggtctcctgcaaggcttctggttacacctttacctactatggtatcagctgggtgcgacaggcccctggacaaggccttgagtggatgggatggatcaacccttataccggtaacagaaactatgcacagaaggtccaggacagagtcaccatgaccacagacacatccacgaacacagcctacatggagctgaggagcctgagatctgacgacacggccgtgtattactgtgcgagaggaagtgggggctttgactactggggccagggaaccctggtcaccgtctcctca

SEQ ID NO: 424 - protein, 116 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSS

SEQ ID NO: 425 - DNA, 336 bp, Artificial Sequence
  Synthetic polynucleotide
gacatcgtgatgacccagtctccactctccctgcccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaagctggagatcaaa

SEQ ID NO: 426 - protein, 112 aa, Artificial Sequence; identical to SEQ ID NO: 413
  Synthetic polypeptide

SEQ ID NO: 427 - DNA, 729 bp, Artificial Sequence
  Synthetic polynucleotide
caggtgcagctggtccagtctggggctgaggtgaaggagcccggggcctcagtgaaggtctcctgcaaggcttctggttacacctttacctactatggtatcagctgggtgcgacaggcccctggacaaggccttgagtggatgggatggatcaacccttataccggtaacagaaactatgcacagaaggtccaggacagagtcaccatgaccacagacacatccacgaacacagcctacatggagctgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgacccagtctccactctccctgcccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaagctggagatcaaa

SEQ ID NO: 428 - protein, 243 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIK

SEQ ID NO: 429 - protein, 504 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 430 - protein, 5 aa, Artificial Sequence
  Synthetic polypeptide
YYGIS

SEQ ID NO: 431 - protein, 17 aa, Artificial Sequence
  Synthetic polypeptide
WINPYTGKTNYAQKLQG

SEQ ID NO: 432 - protein, 7 aa, Artificial Sequence
  Synthetic polypeptide
GSGGFDY

SEQ ID NO: 433 - protein, 16 aa, Artificial Sequence
  Synthetic polypeptide
RSSQSLLHSVGYNYLD

SEQ ID NO: 434 - protein, 7 aa, Artificial Sequence
  Synthetic polypeptide
LGSNRAS

SEQ ID NO: 435 - protein, 9 aa, Artificial Sequence
  Synthetic polypeptide
MQALQTPFT

SEQ ID NO: 436 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaagggctcgagtggatgggatggatcaacccttacaccggtaagacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctca

SEQ ID NO: 437 - protein, 116 aa, Artificial Sequence; identical to SEQ ID NO: 359
  Synthetic polypeptide

SEQ ID NO: 438 - DNA, 336 bp, Artificial Sequence
  Synthetic polynucleotide
gacatcgtgatgactcagtctccactctccctgcccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaggtggaaatcaaa

SEQ ID NO: 439 - protein, 112 aa, Artificial Sequence
  Synthetic polypeptide
DIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIK

SEQ ID NO: 440 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaagggctcgagtggatgggatggatcaacccttacaccggtaagacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgactcagtctccactctccctgcccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaggtggaaatcaaa

SEQ ID NO: 441 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIK

SEQ ID NO: 442 - protein, 504 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 443 - protein, 5 aa, Artificial Sequence
  Synthetic polypeptide
SYGIT

SEQ ID NO: 444 - protein, 17 aa, Artificial Sequence
  Synthetic polypeptide
WINPYTGNRNYAQKVQG

SEQ ID NO: 445 - protein, 7 aa, Artificial Sequence
  Synthetic polypeptide
GSGGFDY

SEQ ID NO: 446 - protein, 16 aa, Artificial Sequence
  Synthetic polypeptide
RSSQSLLHSVGYNYLD

SEQ ID NO: 447 - protein, 7 aa, Artificial Sequence
  Synthetic polypeptide
LGSNRAS

SEQ ID NO: 448 - protein, 9 aa, Artificial Sequence
  Synthetic polypeptide
MQALQTPFT

SEQ ID NO: 449 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttaccagctatggtatcacctgggtgcgacaggcccctggacaagggcttgagtggatgggatggatcaacccttacaccggtaacagaaactatgcacagaaggtccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctca

SEQ ID NO: 450 - protein, 116 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSS

SEQ ID NO: 451 - DNA, 336 bp, Artificial Sequence
  Synthetic polynucleotide
gacatcgtgatgactcagtctccactctctctgtccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 452 - protein, 112 aa, Artificial Sequence
  Synthetic polypeptide
DIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 453 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttaccagctatggtatcacctgggtgcgacaggcccctggacaagggcttgagtggatgggatggatcaacccttacaccggtaacagaaactatgcacagaaggtccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgactcagtctccactctctctgtccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 454 - protein, 243 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 455 - protein, 504 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 456 - protein, 5 aa, Artificial Sequence
  Synthetic polypeptide
SYGIS

SEQ ID NO: 457 - protein, 17 aa, Artificial Sequence
  Synthetic polypeptide
WINPYTGNRNYAQKFQG

SEQ ID NO: 458 - protein, 7 aa, Artificial Sequence
  Synthetic polypeptide
GSGGFDY

SEQ ID NO: 459 - protein, 16 aa, Artificial Sequence
  Synthetic polypeptide
RSSQSLLHSVGYNYLD

SEQ ID NO: 460 - protein, 7 aa, Artificial Sequence
  Synthetic polypeptide
LGSNRAS

SEQ ID NO: 461 - protein, 9 aa, Artificial Sequence
  Synthetic polypeptide
MQALQTPFT

SEQ ID NO: 462 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttaccagctatggtatcagctgggtgcgacaggcccctggacaagggcttgagtggatgggatggatcaacccttacaccggtaacagaaactatgcacagaagttccagggcagagtcaccatgaccacagacacatccacgaacacagcctacatggagctgagcagcttgagatctgaggacacggccgtgtattactgtgcgagaggaagtgggggctttgactactggggccagggaaccctggtcaccgtctcctca

SEQ ID NO: 463 - protein, 116 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSS

SEQ ID NO: 464 - DNA, 336 bp, Artificial Sequence
  Synthetic polynucleotide
gacatcgtgatgactcagtctccactctccctgcccgtcacccctggagagccggcctccatctcctgcaggtctagtcagagcctcctgcatagtgtgggatacaactatttggattggtacctgcagaagccagggcagtctccacagctcctgatctacttgggttctaatcgggcctccggggtccctgacaggttcagtggcagtggatcaggcacagattttacactgaaaatcagcagagtggaggctgaggatgttggggtttattactgcatgcaagctctacaaactccattcactttcggtcctgggaccaaagtggatatcaaa

SEQ ID NO: 465 - protein, 112 aa, Artificial Sequence
  Synthetic polypeptide
DIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 466 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttaccagctatggtatcagctgggtgcgacaggcccctggacaagggcttgagtggatgggatggatcaacccttacaccggtaacagaaactatgcacagaagttccagggcagagtcaccatgaccacagacacatccacgaacacagcctacatggagctgagcagcttgagatctgaggacacggccgtgtattactgtgcgagaggaagtgggggctttgactactggggccagggaaccctggtcaccgtctcctcaggtggtggtggttctggcggcggcggctccggtggtggtggttctgacatcgtgatgactcagtctccactctccctgcccgtcacccctggagagccggcctccatctcctgcaggtctagtcagagcctcctgcatagtgtgggatacaactatttggattggtacctgcagaagccagggcagtctccacagctcctgatctacttgggttctaatcgggcctccggggtccctgacaggttcagtggcagtggatcaggcacagattttacactgaaaatcagcagagtggaggctgaggatgttggggtttattactgcatgcaagctctacaaactccattcactttcggtcctgggaccaaagtggatatcaaa

SEQ ID NO: 467 - protein, 243 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 468 - protein, 504 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 469 - protein, 5 aa, Artificial Sequence
  Synthetic polypeptide
SYGIS

SEQ ID NO: 470 - protein, 17 aa, Artificial Sequence
  Synthetic polypeptide
WINPYTGNRNYAQKVQG

SEQ ID NO: 471 - protein, 7 aa, Artificial Sequence
  Synthetic polypeptide
GSGGFDY

SEQ ID NO: 472 - protein, 16 aa, Artificial Sequence
  Synthetic polypeptide
RSSQSLLHSVGYNYLD

SEQ ID NO: 473 - protein, 7 aa, Artificial Sequence
  Synthetic polypeptide
LGSNRAS

SEQ ID NO: 474 - protein, 9 aa, Artificial Sequence
  Synthetic polypeptide
MQALQTPFT

SEQ ID NO: 475 - DNA, 348 bp, Artificial Sequence
  Synthetic polynucleotide
caggtgcagctggtccagtctggggctgaggtgaagaagcctggggcctcagtgaaggtctcctgcaaggcttctggttacagctttaccagttatggtatcagctgggtgcgacaggcccctggacaagggcttgagtggatgggatggatcaacccttataccggtaacagaaattatgcacagaaggtccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctca

SEQ ID NO: 476 - protein, 116 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSS

SEQ ID NO: 477 - DNA, 336 bp, Artificial Sequence
  Synthetic polynucleotide
gacatcgtgatgacccagtctccactctccctgcccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaggtggaaatcaaa

SEQ ID NO: 478 - protein, 112 aa, Artificial Sequence; identical to SEQ ID NO: 439
  Synthetic polypeptide

SEQ ID NO: 479 - DNA, 729 bp, Artificial Sequence
  Synthetic polynucleotide
caggtgcagctggtccagtctggggctgaggtgaagaagcctggggcctcagtgaaggtctcctgcaaggcttctggttacagctttaccagttatggtatcagctgggtgcgacaggcccctggacaagggcttgagtggatgggatggatcaacccttataccggtaacagaaattatgcacagaaggtccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgacccagtctccactctccctgcccgtcacccctggagagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaggtggaaatcaaa

SEQ ID NO: 480 - protein, 243 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIK

SEQ ID NO: 481 - protein, 504 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 482 - protein, 5 aa, Artificial Sequence
  Synthetic polypeptide
YYGIS

SEQ ID NO: 483 - protein, 17 aa, Artificial Sequence
  Synthetic polypeptide
WINPYTGKTNYAQKVQG

SEQ ID NO: 484 - protein, 7 aa, Artificial Sequence
  Synthetic polypeptide
GSGGFDY

SEQ ID NO: 485 - protein, 16 aa, Artificial Sequence
  Synthetic polypeptide
RSSQSLLHSVGYNYLD

SEQ ID NO: 486 - protein, 7 aa, Artificial Sequence
  Synthetic polypeptide
LGSNRAS

SEQ ID NO: 487 - protein, 9 aa, Artificial Sequence
  Synthetic polypeptide
MQALQTPFT

SEQ ID NO: 488 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttacaccggtaagacaaactacgcacagaaggtccagggcagagtcaccatgaccacagacacatccacgagcacagcctacatggagctgaggaacctgagatctgacgacacggccgtgtattactgtgcgagaggaagtgggggctttgactactggggccagggaaccctggtcaccgtctcctca

SEQ ID NO: 489 - protein, 116 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSS

SEQ ID NO: 490 - DNA, 336 bp, Artificial Sequence
  Synthetic polynucleotide
gacatcgtgatgacccagactccactctctctgtccgtcacccctggacagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 491 - protein, 112 aa, Artificial Sequence
  Synthetic polypeptide
DIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 492 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttacaccggtaagacaaactacgcacagaaggtccagggcagagtcaccatgaccacagacacatccacgagcacagcctacatggagctgaggaacctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgacccagactccactctctctgtccgtcacccctggacagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccattcactttcggccctgggaccaaagtggatatcaaa

SEQ ID NO: 493 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 494 - protein, 504 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 495 - protein, 5 aa, Artificial Sequence
  Synthetic polypeptide
YYGIS

SEQ ID NO: 496 - protein, 17 aa, Artificial Sequence
  Synthetic polypeptide
WINPYTGKTNYAQKLQG

SEQ ID NO: 497 - protein, 7 aa, Artificial Sequence
  Synthetic polypeptide
GSGGFDY

SEQ ID NO: 498 - protein, 16 aa, Artificial Sequence
  Synthetic polypeptide
RSSQSLLHSVGYNYLD

SEQ ID NO: 499 - protein, 7 aa, Artificial Sequence
  Synthetic polypeptide
LGSNRAS

SEQ ID NO: 500 - protein, 9 aa, Artificial Sequence
  Synthetic polypeptide
MQALQTPFT

SEQ ID NO: 501 - DNA, 348 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttataccggtaagacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctca

SEQ ID NO: 502 - protein, 116 aa, Artificial Sequence; identical to SEQ ID NO: 359
  Synthetic polypeptide

SEQ ID NO: 503 - DNA, 336 bp, Artificial Sequence
  Synthetic polynucleotide
gacatcgtgatgacccagactccactctctctgtccgtcacccctggacagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtgggtcaggcactgatttcacactgaaaatcagcagggtggaggctgaggatgttggagtttattactgcatgcaagctctacaaactccattcactttcggccctgggaccaaagtggatatcaaa

SEQ ID NO: 504 - protein, 112 aa, Artificial Sequence; identical to SEQ ID NO: 491
  Synthetic polypeptide

SEQ ID NO: 505 - DNA, 729 bp, Artificial Sequence
  Synthetic polynucleotide
caggtgcagctggtccagtctggggctgaggtgaagaagcctggggcctcagtgaaggtctcctgcaaggcttctggttacacctttacctactatggtatcagctgggtgcgacaggcccctggacaaggccttgagtggatgggatggatcaacccttataccggtaagacaaactatgcacagaagctccagggcagagtcaccatgaccacagacacatccacgagcacagcctacatggagctgaggagcctgagatctgacgacacggccgtgtattactgtgcgagaggaagtgggggctttgactactggggccagggaaccctggtcaccgtctcctcaggtggtggtggttctggcggcggcggctccggtggtggtggttctgacatcgtgatgacccagactccactctctctgtccgtcacccctggacagccggcctccatctcctgcaggtctagtcagagcctcctgcatagtgtgggatacaactatttggattggtacctgcagaagccagggcagtctccacagctcctgatctatttgggttctaatcgggcctccggggtccctgacaggttcagtggcagtgggtcaggcactgatttcacactgaaaatcagcagggtggaggctgaggatgttggagtttattactgcatgcaagctctacaaactccattcactttcggccctgggaccaaagtggatatcaaa

SEQ ID NO: 506 - protein, 243 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIK

SEQ ID NO: 507 - protein, 504 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 508 - protein, 5 aa, Artificial Sequence
  Synthetic polypeptide
NYAMH

SEQ ID NO: 509 - protein, 17 aa, Artificial Sequence
  Synthetic polypeptide
VISYSGNNKYYASSVKG

SEQ ID NO: 510 - protein, 17 aa, Artificial Sequence
  Synthetic polypeptide
EFYYDSTGYDYSTPGDY

SEQ ID NO: 511 - protein, 11 aa, Artificial Sequence
  Synthetic polypeptide
QASQDISNYLN

SEQ ID NO: 512 - protein, 7 aa, Artificial Sequence
  Synthetic polypeptide
DASNLET

SEQ ID NO: 513 - protein, 8 aa, Artificial Sequence
  Synthetic polypeptide
QQYDNLPT

SEQ ID NO: 514 - DNA, 378 bp, Artificial Sequence
  Synthetic polynucleotide
caggtgcagctggtcgagtctgggggaggcgtggtccagcctgggaggtccctgagactctcctgtgcagcgtctggattcaccttcagaaactatgccatgcactgggtccgccaggctccaggcaaggggctggagtgggtggcagttatatcatattctggaaataataaatactatgcaagttccgtgaagggccgattcaccatctccagagacaattccaagaacacgctgtatctgcaattgaacagcctgagagctgaggacacggctgtgtattactgtgcgagagagttttactatgatagtactggttatgactactcaactccgggagactactggggccagggaaccctggtcaccgtctcctca

SEQ ID NO: 515 - protein, 126 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSS

SEQ ID NO: 516 - DNA, 318 bp, Artificial Sequence
  Synthetic polynucleotide
gacatccagatgacccagtctccatcctccctgtctgcatctgtaggagacagagtcactatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctaccttcggccaagggacacgactggagattaaa

SEQ ID NO: 517 - protein, 106 aa, Artificial Sequence
  Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIK

SEQ ID NO: 518 - DNA, 741 bp, Artificial Sequence
  Synthetic polynucleotide
caggtgcagctggtcgagtctgggggaggcgtggtccagcctgggaggtccctgagactctcctgtgcagcgtctggattcaccttcagaaactatgccatgcactgggtccgccaggctccaggcaaggggctggagtgggtggcagttatatcatattctggaaataataaatactatgcaagttccgtgaagggccgattcaccatctccagagacaattccaagaacacgctgtatctgcaattgaacagcctgagagctgaggacacggctgtgtattactgtgcgagagagttttactatgatagtactggttatgactactcaactccgggagactactggggccagggaaccctggtcaccgtctcctcaggtggtggtggttctggcggcggcggctccggtggtggtggttctgacatccagatgacccagtctccatcctccctgtctgcatctgtaggagacagagtcactatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctaccttcggccaagggacacgactggagattaaa

SEQ ID NO: 519 - protein, 247 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIK

SEQ ID NO: 520 - protein, 508 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 521 - protein, 5 aa, Artificial Sequence
  Synthetic polypeptide
NYAMH

SEQ ID NO: 522 - protein, 17 aa, Artificial Sequence
  Synthetic polypeptide
VISYSGNNKYYASSVKG

SEQ ID NO: 523 - protein, 17 aa, Artificial Sequence
  Synthetic polypeptide
EFYYDSTGYDYSTPGDY

SEQ ID NO: 524 - protein, 11 aa, Artificial Sequence
  Synthetic polypeptide
RASQSISSYLN

SEQ ID NO: 525 - protein, 7 aa, Artificial Sequence
  Synthetic polypeptide
DASSLQS

SEQ ID NO: 526 - protein, 9 aa, Artificial Sequence
  Synthetic polypeptide
QQYYSTPLT

SEQ ID NO: 527 - DNA, 378 bp, Artificial Sequence
  Synthetic polynucleotide
caggtgcagctggtcgagtctgggggaggcgtggtccagcctgggaggtccctgagactctcctgtgtagcctctggattcaccttcagaaactatgccatgcactgggtccgccaggctccaggcaaggggctggagtgggtggcagttatatcatattctggaaataataaatactatgcaagttccgtgaagggccgattcaccatctccagagacaattccaagaacacgctgtatctgcaattgaacagcctgagagctgaggacacggctgtgtattactgtgcgagagagttttactatgatagtactggttatgactactcaactccgggagactactggggccagggaaccctggtcaccgtctcctca

SEQ ID NO: 528 - protein, 126 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSS

SEQ ID NO: 529 - DNA, 321 bp, Artificial Sequence
  Synthetic polynucleotide
gacatccagatgacccagtctccatcctccctgtctgcatctgtaggagacagagtcaccatcacttgccgggcaagtcagagcattagcagctatttaaattggtatcaacagaaaccagggaaagcccctaaactcctgatctacgatgcatccagtttgcaaagtggggtcccatcaaggttcagcggcagtggatctgggacagaattcactctcacaatcagcagcctgcaggctgaagatgtggcagtttattactgtcagcaatattatagtactccgctcactttcggcggagggaccaaagtggatatcaaa

SEQ ID NO: 530 - protein, 107 aa, Artificial Sequence
  Synthetic polypeptide
DIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIK

SEQ ID NO: 531 - DNA, 744 bp, Artificial Sequence
  Synthetic polynucleotide
caggtgcagctggtcgagtctgggggaggcgtggtccagcctgggaggtccctgagactctcctgtgtagcctctggattcaccttcagaaactatgccatgcactgggtccgccaggctccaggcaaggggctggagtgggtggcagttatatcatattctggaaataataaatactatgcaagttccgtgaagggccgattcaccatctccagagacaattccaagaacacgctgtatctgcaattgaacagcctgagagctgaggacacggctgtgtattactgtgcgagagagttttactatgatagtactggttatgactactcaactccgggagactactggggccagggaaccctggtcaccgtctcctcaggtggtggtggttctggcggcggcggctccggtggtggtggttctgacatccagatgacccagtctccatcctccctgtctgcatctgtaggagacagagtcaccatcacttgccgggcaagtcagagcattagcagctatttaaattggtatcaacagaaaccagggaaagcccctaaactcctgatctacgatgcatccagtttgcaaagtggggtcccatcaaggttcagcggcagtggatctgggacagaattcactctcacaatcagcagcctgcaggctgaagatgtggcagtttattactgtcagcaatattatagtactccgctcactttcggcggagggaccaaagtggatatcaaa

SEQ ID NO: 532 - protein, 248 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIK

SEQ ID NO: 533 - protein, 509 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 534 - protein, 5 aa, Artificial Sequence
  Synthetic polypeptide
NYAMH

SEQ ID NO: 535 - protein, 17 aa, Artificial Sequence
  Synthetic polypeptide
GISYSGTNKYYASSVKG

SEQ ID NO: 536 - protein, 17 aa, Artificial Sequence
  Synthetic polypeptide
EFYYDSTGYDYSTPGDY

SEQ ID NO: 537 - protein, 11 aa, Artificial Sequence
  Synthetic polypeptide
QASQDISNYLN

SEQ ID NO: 538 - protein, 7 aa, Artificial Sequence
  Synthetic polypeptide
DASNLET

SEQ ID NO: 539 - protein, 9 aa, Artificial Sequence
  Synthetic polypeptide
QQYDNLPLT

SEQ ID NO: 540 - DNA, 378 bp, Artificial Sequence
  Synthetic polynucleotide
caggtgcagctggtcgagtctgggggaggcgtggtccagcctgggaggtccctgagactctcctgtgcagcctctggattcaccttcagaaactatgccatgcactgggtccgccaggctccaggcaaggggctggagtgggtggcaggtatatcatattctggaactaataaatactatgcaagttccgtgaagggccgattcaccatctccagagacaattccaagaacacgctgtatctgcaattgaacagcctgagagctgaggacacggctgtgtattactgtgcgagagagttttactatgatagtactggttatgactactcaactccgggagactactggggccagggaaccctggtcaccgtctcctca

SEQ ID NO: 541 - protein, 126 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSS

SEQ ID NO: 542 - DNA, 321 bp, Artificial Sequence
  Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagcggcagtggatctgggacagaattcactctcacaatcagcagcctgcagcctgaagatattgcaacatattactgtcaacagtatgataatctcccgctcactttcggcggagggaccaaagtggatatcaaa

SEQ ID NO: 543 - protein, 107 aa, Artificial Sequence
  Synthetic polypeptide
DIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIK

SEQ ID NO: 544 - DNA, 744 bp, Artificial Sequence
  Synthetic polynucleotide
caggtgcagctggtcgagtctgggggaggcgtggtccagcctgggaggtccctgagactctcctgtgcagcctctggattcaccttcagaaactatgccatgcactgggtccgccaggctccaggcaaggggctggagtgggtggcaggtatatcatattctggaactaataaatactatgcaagttccgtgaagggccgattcaccatctccagagacaattccaagaacacgctgtatctgcaattgaacagcctgagagctgaggacacggctgtgtattactgtgcgagagagttttactatgatagtactggttatgactactcaactccgggagactactggggccagggaaccctggtcaccgtctcctcaggtggtggtggttctggcggcggcggctccggtggtggtggttctgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagcggcagtggatctgggacagaattcactctcacaatcagcagcctgcagcctgaagatattgcaacatattactgtcaacagtatgataatctcccgctcactttcggcggagggaccaaagtggatatcaaa

SEQ ID NO: 545 - protein, 248 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIK

SEQ ID NO: 546 - protein, 509 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 547 - protein, 5 aa, Artificial Sequence
  Synthetic polypeptide
NYAMH

SEQ ID NO: 548 - protein, 17 aa, Artificial Sequence
  Synthetic polypeptide
VISYSGNNKYYASSVKG

SEQ ID NO: 549 - protein, 17 aa, Artificial Sequence
  Synthetic polypeptide
EFYYDSTGYDYSTPGNY

SEQ ID NO: 550 - protein, 11 aa, Artificial Sequence
  Synthetic polypeptide
QASQDISNYLN

SEQ ID NO: 551 - protein, 7 aa, Artificial Sequence
  Synthetic polypeptide
DASNLET

SEQ ID NO: 552 - protein, 9 aa, Artificial Sequence
  Synthetic polypeptide
QQYVNLPLT

SEQ ID NO: 553 - DNA, 378 bp, Artificial Sequence
  Synthetic polynucleotide
caggtgcagctggtcgagtctgggggaggcgtggtccagcctgggaggtccctgagactctcctgtgtagcctctggattcaccttcagaaactatgccatgcactgggtccgccaggctccaggcaaggggctggagtgggtggcagttatatcatattctggaaataataaatactatgcaagttccgtgaagggccgattcaccatctccagagacaattccaagaacacgctgtttctgcaattgaacagcctgagagctgaggacacggctgtgtattactgtgcgagagagttttactatgatagtactggttatgactactcaactccgggaaactactggggccagggaaccctggtcaccgtctcctca

SEQ ID NO: 554 - protein, 126 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSS

SEQ ID NO: 555 - DNA, 321 bp, Artificial Sequence
  Synthetic polynucleotide
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgttaatctcccgctcactttcggcggagggaccaagctggagatcaaa

SEQ ID NO: 556 - protein, 107 aa, Artificial Sequence
  Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIK

SEQ ID NO: 557 - DNA, 744 bp, Artificial Sequence
  Synthetic polynucleotide
caggtgcagctggtcgagtctgggggaggcgtggtccagcctgggaggtccctgagactctcctgtgtagcctctggattcaccttcagaaactatgccatgcactgggtccgccaggctccaggcaaggggctggagtgggtggcagttatatcatattctggaaataataaatactatgcaagttccgtgaagggccgattcaccatctccagagacaattccaagaacacgctgtttctgcaattgaacagcctgagagctgaggacacggctgtgtattactgtgcgagagagttttactatgatagtactggttatgactactcaactccgggaaactactggggccagggaaccctggtcaccgtctcctcaggtggtggtggttctggcggcggcggctccggtggtggtggttctgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgttaatctcccgctcactttcggcggagggaccaagctggagatcaaa

SEQ ID NO: 558 - protein, 248 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIK

SEQ ID NO: 559 - protein, 509 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 560 - protein, 5 aa, Artificial Sequence
  Synthetic polypeptide
SYGMQ

SEQ ID NO: 561 - protein, 17 aa, Artificial Sequence
  Synthetic polypeptide
VIWYSGSNKYYASSVKG

SEQ ID NO: 562 - protein, 14 aa, Artificial Sequence
  Synthetic polypeptide
DGYPIFYRYYGMDV

SEQ ID NO: 563 - protein, 11 aa, Artificial Sequence
  Synthetic polypeptide
RASQGISNYLA

SEQ ID NO: 564 - protein, 7 aa, Artificial Sequence
  Synthetic polypeptide
AASTLQS

SEQ ID NO: 565 - protein, 9 aa, Artificial Sequence
  Synthetic polypeptide
QKYNSAPLT

SEQ ID NO: 566 - DNA, 369 bp, Artificial Sequence
  Synthetic polynucleotide
caggtgcagctggtcgagtctgggggaggcgtggtccagcctgggaggtccctgagactctcctgtgcagcgtctggattcaccttcagtagctatggtatgcagtgggtccgccaggctccaggcaaggggctggagtgggtggcagttatatggtattctggaagtaataaatactatgcaagttccgtgaagggccgattcaccatctccagagacaattccaagaacacgctgtatctgcaaatgaacagcctgagagccgaggacacggctgtgtattactgtgcgagagacgggtatccgatcttctaccgctactacggtatggacgtctggggccaagggaccacggtcaccgtctcctca

SEQ ID NO: 567 - protein, 123 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSS

SEQ ID NO: 568 - DNA, 321 bp, Artificial Sequence
  Synthetic polynucleotide
gacatccagatgacccagtctccgtcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctctcactttcggcggagggaccaaggtggaaatcaaa

SEQ ID NO: 569 - protein, 107 aa, Artificial Sequence
  Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIK

SEQ ID NO: 570 - DNA, 735 bp, Artificial Sequence
  Synthetic polynucleotide
caggtgcagctggtcgagtctgggggaggcgtggtccagcctgggaggtccctgagactctcctgtgcagcgtctggattcaccttcagtagctatggtatgcagtgggtccgccaggctccaggcaaggggctggagtgggtggcagttatatggtattctggaagtaataaatactatgcaagttccgtgaagggccgattcaccatctccagagacaattccaagaacacgctgtatctgcaaatgaacagcctgagagccgaggacacggctgtgtattactgtgcgagagacgggtatccgatcttctaccgctactacggtatggacgtctggggccaagggaccacggtcaccgtctcctcaggtggtggtggttctggcggcggcggctccggtggtggtggttctgacatccagatgacccagtctccgtcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctctcactttcggcggagggaccaaggtggaaatcaaa

SEQ ID NO: 571 - protein, 245 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIK

SEQ ID NO: 572 - protein, 506 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 573 - protein, 5 aa, Artificial Sequence
  Synthetic polypeptide
SYGMH

SEQ ID NO: 574 - protein, 17 aa, Artificial Sequence
  Synthetic polypeptide
VISYSGSNKYYASSVKG

SEQ ID NO: 575 - protein, 14 aa, Artificial Sequence
  Synthetic polypeptide
DGYPIFYRYYGMDV

SEQ ID NO: 576 - protein, 12 aa, Artificial Sequence
  Synthetic polypeptide
RASQSVSSSYLA

SEQ ID NO: 577 - protein, 7 aa, Artificial Sequence
  Synthetic polypeptide
GASSRAT

SEQ ID NO: 578 - protein, 9 aa, Artificial Sequence
  Synthetic polypeptide
QQYGTSPLT

SEQ ID NO: 579 - DNA, 369 bp, Artificial Sequence
  Synthetic polynucleotide
caggtgcagctggtcgagtcagggggaggcgtggtccagcctgggaggtccctgagactctcctgtgcagcgtctggattcaccttcagtagctatggtatgcactgggtccgccaggctccaggcaaggggctggagtgggtggcagttatatcatattctggaagtaataaatactatgcaagttccgtgaagggccgattcaccatctccagagacaattccaagaacacgctgtatctgcaaatgaacagcctgagagccgaggacacggctgtgtattactgtgcgagagacgggtatccgatcttctaccgctactacggtatggacgtctggggccaagggaccacggtcaccgtctcctca

SEQ ID NO: 580 - protein, 123 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSS

SEQ ID NO: 581 - DNA, 324 bp, Artificial Sequence
  Synthetic polynucleotide
gagatcgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagtagactggagcctgaagatctcgcagtgtattactgtcagcagtatggtacctcaccgctcactttcggcggagggaccaagctggagatcaaa

SEQ ID NO: 582 - protein, 108 aa, Artificial Sequence
  Synthetic polypeptide
EIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIK

SEQ ID NO: 583 - DNA, 738 bp, Artificial Sequence
  Synthetic polynucleotide
caggtgcagctggtcgagtcagggggaggcgtggtccagcctgggaggtccctgagactctcctgtgcagcgtctggattcaccttcagtagctatggtatgcactgggtccgccaggctccaggcaaggggctggagtgggtggcagttatatcatattctggaagtaataaatactatgcaagttccgtgaagggccgattcaccatctccagagacaattccaagaacacgctgtatctgcaaatgaacagcctgagagccgaggacacggctgtgtattactgtgcgagagacgggtatccgatcttctaccgctactacggtatggacgtctggggccaagggaccacggtcaccgtctcctcaggtggtggtggttctggcggcggcggctccggtggtggtggttctgagatcgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagtagactggagcctgaagatctcgcagtgtattactgtcagcagtatggtacctcaccgctcactttcggcggagggaccaagctggagatcaaa

SEQ ID NO: 584 - protein, 246 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIK

SEQ ID NO: 585 - protein, 507 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 586 - protein, 5 aa, Artificial Sequence
  Synthetic polypeptide
SFGMH

SEQ ID NO: 587 - protein, 17 aa, Artificial Sequence
  Synthetic polypeptide
FIWYSGSNKYYASSVKG

SEQ ID NO: 588 - protein, 14 aa, Artificial Sequence
  Synthetic polypeptide
DGYPIFYYYYGMDV

SEQ ID NO: 589 - protein, 12 aa, Artificial Sequence
  Synthetic polypeptide
RASQSVSSSYLA

SEQ ID NO: 590 - protein, 7 aa, Artificial Sequence
  Synthetic polypeptide
GASSRAT

SEQ ID NO: 591 - protein, 9 aa, Artificial Sequence
  Synthetic polypeptide
QQYGSSPFT

SEQ ID NO: 592 - DNA, 369 bp, Artificial Sequence
  Synthetic polynucleotide
caggtgcagctggtcgagtcagggggaggcgtggtccagcctgggaggtccctgagactctcctgtgcagcgtctggattcaccttcagtagctttggtatgcactgggtccgccaggctccaggcaaggggctggagtgggtggcatttatatggtattccgggagtaataaatactatgcaagttccgtgaagggccgagtcaccatctccagagacaattccaagaacacgctgtatctgcaaatgaacagcctgagagccgaggacacggctgtatattactgtgcgagagacgggtatccgattttctactactactacggtatggacgtctggggccaagggaccacggtcaccgtctcctca

SEQ ID NO: 593 - protein, 123 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSS

SEQ ID NO: 594 - DNA, 324 bp, Artificial Sequence
  Synthetic polynucleotide
gagatcgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccattcactttcggccctgggacacgactggagattaaa

SEQ ID NO: 595 - protein, 108 aa, Artificial Sequence
  Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIK

SEQ ID NO: 596 - DNA, 738 bp, Artificial Sequence
  Synthetic polynucleotide
caggtgcagctggtcgagtcagggggaggcgtggtccagcctgggaggtccctgagactctcctgtgcagcgtctggattcaccttcagtagctttggtatgcactgggtccgccaggctccaggcaaggggctggagtgggtggcatttatatggtattccgggagtaataaatactatgcaagttccgtgaagggccgagtcaccatctccagagacaattccaagaacacgctgtatctgcaaatgaacagcctgagagccgaggacacggctgtatattactgtgcgagagacgggtatccgattttctactactactacggtatggacgtctggggccaagggaccacggtcaccgtctcctcaggtggtggtggttctggcggcggcggctccggtggtggtggttctgagatcgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccattcactttcggccctgggacacgactggagattaaa

SEQ ID NO: 597 - protein, 246 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIK

SEQ ID NO: 598 - protein, 507 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 599 - protein, 5 aa, Artificial Sequence
  Synthetic polypeptide
SYGMH

SEQ ID NO: 600 - protein, 17 aa, Artificial Sequence
  Synthetic polypeptide
FIWYDGSNKYYADSVKD

SEQ ID NO: 601 - protein, 16 aa, Artificial Sequence
  Synthetic polypeptide
RAGIIGTIGYYYGMDV

SEQ ID NO: 602 - protein, 11 aa, Artificial Sequence
  Synthetic polypeptide
SGDRLGEKYTS

SEQ ID NO: 603 - protein, 7 aa, Artificial Sequence
  Synthetic polypeptide
QDTKRPS

SEQ ID NO: 604 - protein, 9 aa, Artificial Sequence
  Synthetic polypeptide
QAWESSTVV

SEQ ID NO: 605 - DNA, 375 bp, Artificial Sequence
  Synthetic polynucleotide
caggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 606 - protein, 125 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSS

SEQ ID NO: 607 - DNA, 318 bp, Artificial Sequence; identical to SEQ ID NO: 9
  Synthetic polynucleotide

SEQ ID NO: 608 - protein, 106 aa, Artificial Sequence; identical to SEQ ID NO: 10
  Synthetic polypeptide

SEQ ID NO: 609 - DNA, 738 bp, Artificial Sequence
  Synthetic polynucleotide
caggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggaggcggaggatctggtggcggtggttctggcggcggaggctcctcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 610 - protein, 246 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 611 - protein, 507 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 612 - protein, 532 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 613 - protein, 529 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 614 - protein, 529 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 615 - protein, 529 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 616 - protein, 529 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 617 - protein, 529 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 618 - protein, 529 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 619 - protein, 528 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 620 - protein, 529 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 621 - protein, 528 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 622 - protein, 528 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 623 - protein, 528 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 624 - protein, 529 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 625 - protein, 528 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 626 - protein, 529 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 627 - protein, 528 aa, Artificial Sequence; identical to SEQ ID NO: 622
  Synthetic polypeptide

SEQ ID NO: 628 - protein, 529 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 629 - protein, 529 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 630 - protein, 529 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 631 - protein, 529 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 632 - protein, 529 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 633 - protein, 528 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 634 - protein, 529 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 635 - protein, 534 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 636 - protein, 528 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 637 - protein, 529 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 638 - protein, 529 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 639 - protein, 529 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 640 - protein, 529 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 641 - protein, 529 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 642 - protein, 529 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 643 - protein, 529 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 644 - protein, 529 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 645 - protein, 529 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 646 - protein, 529 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 647 - protein, 529 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 648 - protein, 529 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 649 - protein, 529 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 650 - protein, 529 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 651 - protein, 533 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 652 - protein, 534 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 653 - protein, 534 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 654 - protein, 534 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 655 - protein, 531 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 656 - protein, 532 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 657 - protein, 532 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 658 - protein, 532 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 659 - protein, 549 aa, Artificial Sequence
  Synthetic polypeptide
QRFVTGHFGGLYPANGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 660 - protein, 546 aa, Artificial Sequence
  Synthetic polypeptide
QRFVTGHFGGLYPANGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 661 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 662 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 663 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 664 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 665 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 666 - protein, 545 aa, Artificial Sequence
  Synthetic polypeptide
QRFVTGHFGGLYPANGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 667 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 668 - protein, 545 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 669 - protein, 545 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 670 - protein, 545 aa, Artificial Sequence
  Synthetic polypeptide
QRFVTGHFGGLYPANGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 671 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 672 - protein, 545 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 673 - protein, 546 aa, Artificial Sequence
  Synthetic polypeptide
QRFVTGHFGGLYPANGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 674 - protein, 545 aa, Artificial Sequence; identical to SEQ ID NO: 669
  Synthetic polypeptide

SEQ ID NO: 675 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 676 - protein, 546 aa, Artificial Sequence
  Synthetic polypeptide
QRFVTGHFGGLYPANGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 677 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 678 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 679 - protein, 546 aa, Artificial Sequence
  Synthetic polypeptide
QRFVTGHFGGLYPANGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 680 - protein, 545 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 681 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 682 - protein, 551 aa, Artificial Sequence
  Synthetic polypeptide
QRFVTGHFGGLYPANGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 683 - protein, 545 aa, Artificial Sequence
  Synthetic polypeptide
QRFVTGHFGGLYPANGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 684 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 685 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 686 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 687 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 688 - protein, 546 aa, Artificial Sequence
  Synthetic polypeptide
QRFVTGHFGGLYPANGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 689 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 690 - protein, 546 aa, Artificial Sequence
  Synthetic polypeptide
QRFVTGHFGGLYPANGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 691 - protein, 546 aa, Artificial Sequence
  Synthetic polypeptide
QRFVTGHFGGLYPANGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 692 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 693 - protein, 546 aa, Artificial Sequence
  Synthetic polypeptide
QRFVTGHFGGLYPANGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 694 - protein, 546 aa, Artificial Sequence
  Synthetic polypeptide
QRFVTGHFGGLYPANGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 695 - protein, 546 aa, Artificial Sequence
  Synthetic polypeptide
QRFVTGHFGGLYPANGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 696 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 697 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 698 - protein, 550 aa, Artificial Sequence
  Synthetic polypeptide
QRFVTGHFGGLYPANGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 699 - protein, 551 aa, Artificial Sequence
  Synthetic polypeptide
QRFVTGHFGGLYPANGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 700 - protein, 551 aa, Artificial Sequence
  Synthetic polypeptide
QRFVTGHFGGLYPANGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 701 - protein, 551 aa, Artificial Sequence
  Synthetic polypeptide
QRFVTGHFGGLYPANGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 702 - protein, 548 aa, Artificial Sequence
  Synthetic polypeptide
QRFVTGHFGGLYPANGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 703 - protein, 549 aa, Artificial Sequence
  Synthetic polypeptide
QRFVTGHFGGLYPANGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 704 - protein, 549 aa, Artificial Sequence
  Synthetic polypeptide
QRFVTGHFGGLYPANGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 705 - protein, 549 aa, Artificial Sequence
  Synthetic polypeptide
QRFVTGHFGGLYPANGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 706 - protein, 574 aa, Artificial Sequence
  Synthetic polypeptide
QRFVTGHFGGLYPANGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 707 - protein, 571 aa, Artificial Sequence
  Synthetic polypeptide
QRFVTGHFGGLYPANGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 708 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 709 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 710 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 711 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 712 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 713 - protein, 570 aa, Artificial Sequence
  Synthetic polypeptide
QRFVTGHFGGLYPANGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 714 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 715 - protein, 570 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 716 - protein, 570 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 717 - protein, 570 aa, Artificial Sequence
  Synthetic polypeptide
QRFVTGHFGGLYPANGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 718 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 719 - protein, 570 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 720 - protein, 571 aa, Artificial Sequence
  Synthetic polypeptide
QRFVTGHFGGLYPANGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 721 - protein, 570 aa, Artificial Sequence; identical to SEQ ID NO: 716
  Synthetic polypeptide

SEQ ID NO: 722 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 723 - protein, 571 aa, Artificial Sequence
  Synthetic polypeptide
QRFVTGHFGGLYPANGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 724 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 725 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 726 - protein, 571 aa, Artificial Sequence
  Synthetic polypeptide
QRFVTGHFGGLYPANGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 727 - protein, 570 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 728 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 729 - protein, 576 aa, Artificial Sequence
  Synthetic polypeptide
QRFVTGHFGGLYPANGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 730 - protein, 570 aa, Artificial Sequence
  Synthetic polypeptide
QRFVTGHFGGLYPANGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 731 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 732 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 733 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 734 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 735 - protein, 571 aa, Artificial Sequence
  Synthetic polypeptide
QRFVTGHFGGLYPANGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 736 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 737 - protein, 571 aa, Artificial Sequence
  Synthetic polypeptide
QRFVTGHFGGLYPANGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 738 - protein, 571 aa, Artificial Sequence
  Synthetic polypeptide
QRFVTGHFGGLYPANGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 739 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 740 - protein, 571 aa, Artificial Sequence
  Synthetic polypeptide
QRFVTGHFGGLYPANGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 741 - protein, 571 aa, Artificial Sequence
  Synthetic polypeptide
QRFVTGHFGGLYPANGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 742 - protein, 571 aa, Artificial Sequence
  Synthetic polypeptide
QRFVTGHFGGLYPANGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 743 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 744 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 745 - protein, 575 aa, Artificial Sequence
  Synthetic polypeptide
QRFVTGHFGGLYPANGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 746 - protein, 576 aa, Artificial Sequence
  Synthetic polypeptide
QRFVTGHFGGLYPANGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 747 - protein, 576 aa, Artificial Sequence
  Synthetic polypeptide
QRFVTGHFGGLYPANGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 748 - protein, 576 aa, Artificial Sequence
  Synthetic polypeptide
QRFVTGHFGGLYPANGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 749 - protein, 573 aa, Artificial Sequence
  Synthetic polypeptide
QRFVTGHFGGLYPANGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 750 - protein, 574 aa, Artificial Sequence
  Synthetic polypeptide
QRFVTGHFGGLYPANGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 751 - protein, 574 aa, Artificial Sequence
  Synthetic polypeptide
QRFVTGHFGGLYPANGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 752 - protein, 574 aa, Artificial Sequence
  Synthetic polypeptide
QRFVTGHFGGLYPANGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 753 - protein, 514 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 754 - protein, 511 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 755 - protein, 511 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 756 - protein, 511 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 757 - protein, 511 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 758 - protein, 511 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 759 - protein, 511 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 760 - protein, 510 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 761 - protein, 511 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 762 - protein, 510 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 763 - protein, 510 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 764 - protein, 510 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 765 - protein, 511 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 766 - protein, 510 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 767 - protein, 511 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 768 - protein, 510 aa, Artificial Sequence; identical to SEQ ID NO: 763
  Synthetic polypeptide

SEQ ID NO: 769 - protein, 511 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 770 - protein, 511 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 771 - protein, 511 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 772 - protein, 511 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 773 - protein, 511 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 774 - protein, 510 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 775 - protein, 511 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 776 - protein, 516 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 777 - protein, 510 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 778 - protein, 511 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 779 - protein, 511 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 780 - protein, 511 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 781 - protein, 511 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 782 - protein, 511 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 783 - protein, 511 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 784 - protein, 511 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 785 - protein, 511 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 786 - protein, 511 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 787 - protein, 511 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 788 - protein, 511 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 789 - protein, 511 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 790 - protein, 511 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 791 - protein, 511 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 792 - protein, 515 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 793 - protein, 516 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 794 - protein, 516 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 795 - protein, 516 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 796 - protein, 513 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 797 - protein, 514 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 798 - protein, 514 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 799 - protein, 514 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 800 - protein, 549 aa, Artificial Sequence
  Synthetic polypeptide
QRFVTGHFGGLHPANGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 801 - protein, 546 aa, Artificial Sequence
  Synthetic polypeptide
QRFVTGHFGGLHPANGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 802 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 803 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 804 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 805 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 806 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 807 - protein, 545 aa, Artificial Sequence
  Synthetic polypeptide
QRFVTGHFGGLHPANGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 808 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 809 - protein, 545 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 810 - protein, 545 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 811 - protein, 545 aa, Artificial Sequence
  Synthetic polypeptide
QRFVTGHFGGLHPANGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 812 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 813 - protein, 545 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 814 - protein, 546 aa, Artificial Sequence
  Synthetic polypeptide
QRFVTGHFGGLHPANGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 815 - protein, 545 aa, Artificial Sequence; identical to SEQ ID NO: 810
  Synthetic polypeptide

SEQ ID NO: 816 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 817 - protein, 546 aa, Artificial Sequence
  Synthetic polypeptide
QRFVTGHFGGLHPANGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 818 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 819 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 820 - protein, 546 aa, Artificial Sequence
  Synthetic polypeptide
QRFVTGHFGGLHPANGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 821 - protein, 545 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 822 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 823 - protein, 551 aa, Artificial Sequence
  Synthetic polypeptide
QRFVTGHFGGLHPANGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 824 - protein, 545 aa, Artificial Sequence
  Synthetic polypeptide
QRFVTGHFGGLHPANGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 825 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 826 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 827 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 828 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 829 - protein, 546 aa, Artificial Sequence
  Synthetic polypeptide
QRFVTGHFGGLHPANGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 830 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 831 - protein, 546 aa, Artificial Sequence
  Synthetic polypeptide
QRFVTGHFGGLHPANGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 832 - protein, 546 aa, Artificial Sequence
  Synthetic polypeptide
QRFVTGHFGGLHPANGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 833 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 834 - protein, 546 aa, Artificial Sequence
  Synthetic polypeptide
QRFVTGHFGGLHPANGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 835 - protein, 546 aa, Artificial Sequence
  Synthetic polypeptide
QRFVTGHFGGLHPANGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 836 - protein, 546 aa, Artificial Sequence
  Synthetic polypeptide
QRFVTGHFGGLHPANGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 837 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 838 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 839 - protein, 550 aa, Artificial Sequence
  Synthetic polypeptide
QRFVTGHFGGLHPANGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 840 - protein, 551 aa, Artificial Sequence
  Synthetic polypeptide
QRFVTGHFGGLHPANGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 841 - protein, 551 aa, Artificial Sequence
  Synthetic polypeptide
QRFVTGHFGGLHPANGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 842 - protein, 551 aa, Artificial Sequence
  Synthetic polypeptide
QRFVTGHFGGLHPANGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 843 - protein, 548 aa, Artificial Sequence
  Synthetic polypeptide
QRFVTGHFGGLHPANGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 844 - protein, 549 aa, Artificial Sequence
  Synthetic polypeptide
QRFVTGHFGGLHPANGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 845 - protein, 549 aa, Artificial Sequence
  Synthetic polypeptide
QRFVTGHFGGLHPANGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 846 - protein, 549 aa, Artificial Sequence
  Synthetic polypeptide
QRFVTGHFGGLHPANGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 847 - protein, 549 aa, Artificial Sequence
  Synthetic polypeptide
QRFVTGHFGGLHPANGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 848 - protein, 546 aa, Artificial Sequence
  Synthetic polypeptide
QRFVTGHFGGLHPANGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 849 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 850 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 851 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 852 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 853 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 854 - protein, 545 aa, Artificial Sequence
  Synthetic polypeptide
QRFVTGHFGGLHPANGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 855 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 856 - protein, 545 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 857 - protein, 545 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 858 - protein, 545 aa, Artificial Sequence
  Synthetic polypeptide
QRFVTGHFGGLHPANGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 859 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 860 - protein, 545 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 861 - protein, 546 aa, Artificial Sequence
  Synthetic polypeptide
QRFVTGHFGGLHPANGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 862 - protein, 545 aa, Artificial Sequence; identical to SEQ ID NO: 857
  Synthetic polypeptide

SEQ ID NO: 863 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 864 - protein, 546 aa, Artificial Sequence
  Synthetic polypeptide
QRFVTGHFGGLHPANGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 865 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 866 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 867 - protein, 546 aa, Artificial Sequence
  Synthetic polypeptide
QRFVTGHFGGLHPANGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 868 - protein, 545 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 869 - protein, 546 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 870 - protein, 551 aa, Artificial Sequence
  Synthetic polypeptide
QRFVTGHFGGLHPANGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 871 - protein, 545 aa, Artificial Sequence
  Synthetic polypeptide
QRFVTGHFGGLHPANGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 872 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 873 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 874 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 875 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 876 - protein, 546 aa, Artificial Sequence
  Synthetic polypeptide
QRFVTGHFGGLHPANGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 877 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 878 - protein, 546 aa, Artificial Sequence
  Synthetic polypeptide
QRFVTGHFGGLHPANGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 879 - protein, 546 aa, Artificial Sequence
  Synthetic polypeptide
QRFVTGHFGGLHPANGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 880 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 881 - protein, 546 aa, Artificial Sequence
  Synthetic polypeptide
QRFVTGHFGGLHPANGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 882 - protein, 546 aa, Artificial Sequence
  Synthetic polypeptide
QRFVTGHFGGLHPANGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 883 - protein, 546 aa, Artificial Sequence
  Synthetic polypeptide
QRFVTGHFGGLHPANGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 884 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 885 - protein, 546 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 886 - protein, 550 aa, Artificial Sequence
  Synthetic polypeptide
QRFVTGHFGGLHPANGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 887 - protein, 551 aa, Artificial Sequence
  Synthetic polypeptide
QRFVTGHFGGLHPANGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 888 - protein, 551 aa, Artificial Sequence
  Synthetic polypeptide
QRFVTGHFGGLHPANGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 889 - protein, 551 aa, Artificial Sequence
  Synthetic polypeptide
QRFVTGHFGGLHPANGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 890 - protein, 548 aa, Artificial Sequence
  Synthetic polypeptide
QRFVTGHFGGLHPANGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 891 - protein, 549 aa, Artificial Sequence
  Synthetic polypeptide
QRFVTGHFGGLHPANGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 892 - protein, 549 aa, Artificial Sequence
  Synthetic polypeptide
QRFVTGHFGGLHPANGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 893 - protein, 549 aa, Artificial Sequence
  Synthetic polypeptide
QRFVTGHFGGLHPANGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 894 - protein, 549 aa, Artificial Sequence
  Synthetic polypeptide
QRFVTGHFGGLYPANGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 895 - protein, 546 aa, Artificial Sequence
  Synthetic polypeptide
QRFVTGHFGGLYPANGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 896 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 897 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 898 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 899 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 900 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 901 - protein, 545 aa, Artificial Sequence
  Synthetic polypeptide
QRFVTGHFGGLYPANGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 902 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 903 - protein, 545 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 904 - protein, 545 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 905 - protein, 545 aa, Artificial Sequence
  Synthetic polypeptide
QRFVTGHFGGLYPANGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 906 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 907 - protein, 545 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 908 - protein, 546 aa, Artificial Sequence
  Synthetic polypeptide
QRFVTGHFGGLYPANGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 909 - protein, 545 aa, Artificial Sequence; identical to SEQ ID NO: 904
  Synthetic polypeptide

SEQ ID NO: 910 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 911 - protein, 546 aa, Artificial Sequence
  Synthetic polypeptide
QRFVTGHFGGLYPANGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 912 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 913 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 914 - protein, 546 aa, Artificial Sequence
  Synthetic polypeptide
QRFVTGHFGGLYPANGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 915 - protein, 545 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 916 - protein, 546 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 917 - protein, 551 aa, Artificial Sequence
  Synthetic polypeptide
QRFVTGHFGGLYPANGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 918 - protein, 545 aa, Artificial Sequence
  Synthetic polypeptide
QRFVTGHFGGLYPANGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 919 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 920 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 921 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 922 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 923 - protein, 546 aa, Artificial Sequence
  Synthetic polypeptide
QRFVTGHFGGLYPANGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 924 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 925 - protein, 546 aa, Artificial Sequence
  Synthetic polypeptide
QRFVTGHFGGLYPANGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 926 - protein, 546 aa, Artificial Sequence
  Synthetic polypeptide
QRFVTGHFGGLYPANGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 927 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 928 - protein, 546 aa, Artificial Sequence
  Synthetic polypeptide
QRFVTGHFGGLYPANGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 929 - protein, 546 aa, Artificial Sequence
  Synthetic polypeptide
QRFVTGHFGGLYPANGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 930 - protein, 546 aa, Artificial Sequence
  Synthetic polypeptide
QRFVTGHFGGLYPANGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 931 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 932 - protein, 546 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 933 - protein, 550 aa, Artificial Sequence
  Synthetic polypeptide
QRFVTGHFGGLYPANGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 934 - protein, 551 aa, Artificial Sequence
  Synthetic polypeptide
QRFVTGHFGGLYPANGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 935 - protein, 551 aa, Artificial Sequence
  Synthetic polypeptide
QRFVTGHFGGLYPANGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 936 - protein, 551 aa, Artificial Sequence
  Synthetic polypeptide
QRFVTGHFGGLYPANGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 937 - protein, 548 aa, Artificial Sequence
  Synthetic polypeptide
QRFVTGHFGGLYPANGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 938 - protein, 549 aa, Artificial Sequence
  Synthetic polypeptide
QRFVTGHFGGLYPANGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 939 - protein, 549 aa, Artificial Sequence
  Synthetic polypeptide
QRFVTGHFGGLYPANGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 940 - protein, 549 aa, Artificial Sequence
  Synthetic polypeptide
QRFVTGHFGGLYPANGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 941 - protein, 574 aa, Artificial Sequence
  Synthetic polypeptide
QRFVTGHFGGLHPANGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 942 - protein, 571 aa, Artificial Sequence
  Synthetic polypeptide
QRFVTGHFGGLHPANGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 943 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 944 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 945 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 946 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 947 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 948 - protein, 570 aa, Artificial Sequence
  Synthetic polypeptide
QRFVTGHFGGLHPANGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 949 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 950 - protein, 570 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 951 - protein, 570 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 952 - protein, 570 aa, Artificial Sequence
  Synthetic polypeptide
QRFVTGHFGGLHPANGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 953 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 954 - protein, 570 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 955 - protein, 571 aa, Artificial Sequence
  Synthetic polypeptide
QRFVTGHFGGLHPANGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 956 - protein, 570 aa, Artificial Sequence; identical to SEQ ID NO: 951
  Synthetic polypeptide

SEQ ID NO: 957 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 958 - protein, 571 aa, Artificial Sequence
  Synthetic polypeptide
QRFVTGHFGGLHPANGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 959 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 960 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 961 - protein, 571 aa, Artificial Sequence
  Synthetic polypeptide
QRFVTGHFGGLHPANGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 962 - protein, 570 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 963 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 964 - protein, 576 aa, Artificial Sequence
  Synthetic polypeptide
QRFVTGHFGGLHPANGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 965 - protein, 570 aa, Artificial Sequence
  Synthetic polypeptide
QRFVTGHFGGLHPANGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 966 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 967 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 968 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 969 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 970 - protein, 571 aa, Artificial Sequence
  Synthetic polypeptide
QRFVTGHFGGLHPANGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 971 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 972 - protein, 571 aa, Artificial Sequence
  Synthetic polypeptide
QRFVTGHFGGLHPANGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 973 - protein, 571 aa, Artificial Sequence
  Synthetic polypeptide
QRFVTGHFGGLHPANGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 974 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 975 - protein, 571 aa, Artificial Sequence
  Synthetic polypeptide
QRFVTGHFGGLHPANGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 976 - protein, 571 aa, Artificial Sequence
  Synthetic polypeptide
QRFVTGHFGGLHPANGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 977 - protein, 571 aa, Artificial Sequence
  Synthetic polypeptide
QRFVTGHFGGLHPANGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 978 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 979 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 980 - protein, 575 aa, Artificial Sequence
  Synthetic polypeptide
QRFVTGHFGGLHPANGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 981 - protein, 576 aa, Artificial Sequence
  Synthetic polypeptide
QRFVTGHFGGLHPANGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 982 - protein, 576 aa, Artificial Sequence
  Synthetic polypeptide
QRFVTGHFGGLHPANGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 983 - protein, 576 aa, Artificial Sequence
  Synthetic polypeptide
QRFVTGHFGGLHPANGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 984 - protein, 573 aa, Artificial Sequence
  Synthetic polypeptide
QRFVTGHFGGLHPANGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 985 - protein, 574 aa, Artificial Sequence
  Synthetic polypeptide
QRFVTGHFGGLHPANGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 986 - protein, 574 aa, Artificial Sequence
  Synthetic polypeptide
QRFVTGHFGGLHPANGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 987 - protein, 574 aa, Artificial Sequence
  Synthetic polypeptide
QRFVTGHFGGLHPANGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 988 - protein, 574 aa, Artificial Sequence
  Synthetic polypeptide
QRFVTGHFGGLHPANGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 989 - protein, 571 aa, Artificial Sequence
  Synthetic polypeptide
QRFVTGHFGGLHPANGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 990 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 991 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 992 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 993 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 994 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 995 - protein, 570 aa, Artificial Sequence
  Synthetic polypeptide
QRFVTGHFGGLHPANGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 996 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 997 - protein, 570 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 998 - protein, 570 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 999 - protein, 570 aa, Artificial Sequence
  Synthetic polypeptide
QRFVTGHFGGLHPANGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1000 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1001 - protein, 570 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1002 - protein, 571 aa, Artificial Sequence
  Synthetic polypeptide
QRFVTGHFGGLHPANGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1003 - protein, 570 aa, Artificial Sequence; identical to SEQ ID NO: 998
  Synthetic polypeptide

SEQ ID NO: 1004 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1005 - protein, 571 aa, Artificial Sequence
  Synthetic polypeptide
QRFVTGHFGGLHPANGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1006 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1007 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1008 - protein, 571 aa, Artificial Sequence
  Synthetic polypeptide
QRFVTGHFGGLHPANGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1009 - protein, 570 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1010 - protein, 571 aa, Artificial Sequence
  Synthetic polypeptide
QRFVTGHFGGLHPANGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1011 - protein, 576 aa, Artificial Sequence
  Synthetic polypeptide
QRFVTGHFGGLHPANGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1012 - protein, 570 aa, Artificial Sequence
  Synthetic polypeptide
QRFVTGHFGGLHPANGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1013 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1014 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1015 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1016 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1017 - protein, 571 aa, Artificial Sequence
  Synthetic polypeptide
QRFVTGHFGGLHPANGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1018 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1019 - protein, 571 aa, Artificial Sequence
  Synthetic polypeptide
QRFVTGHFGGLHPANGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1020 - protein, 571 aa, Artificial Sequence
  Synthetic polypeptide
QRFVTGHFGGLHPANGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1021 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1022 - protein, 571 aa, Artificial Sequence
  Synthetic polypeptide
QRFVTGHFGGLHPANGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1023 - protein, 571 aa, Artificial Sequence
  Synthetic polypeptide
QRFVTGHFGGLHPANGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1024 - protein, 571 aa, Artificial Sequence
  Synthetic polypeptide
QRFVTGHFGGLHPANGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1025 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1026 - protein, 571 aa, Artificial Sequence
  Synthetic polypeptide
QRFVTGHFGGLHPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1027 - protein, 575 aa, Artificial Sequence
  Synthetic polypeptide
QRFVTGHFGGLHPANGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1028 - protein, 576 aa, Artificial Sequence
  Synthetic polypeptide
QRFVTGHFGGLHPANGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1029 - protein, 576 aa, Artificial Sequence
  Synthetic polypeptide
QRFVTGHFGGLHPANGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1030 - protein, 576 aa, Artificial Sequence
  Synthetic polypeptide
QRFVTGHFGGLHPANGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1031 - protein, 573 aa, Artificial Sequence
  Synthetic polypeptide
QRFVTGHFGGLHPANGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1032 - protein, 574 aa, Artificial Sequence
  Synthetic polypeptide
QRFVTGHFGGLHPANGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1033 - protein, 574 aa, Artificial Sequence
  Synthetic polypeptide
QRFVTGHFGGLHPANGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1034 - protein, 574 aa, Artificial Sequence
  Synthetic polypeptide
QRFVTGHFGGLHPANGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1035 - protein, 574 aa, Artificial Sequence
  Synthetic polypeptide
QRFVTGHFGGLYPANGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1036 - protein, 571 aa, Artificial Sequence
  Synthetic polypeptide
QRFVTGHFGGLYPANGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1037 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1038 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1039 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1040 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1041 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1042 - protein, 570 aa, Artificial Sequence
  Synthetic polypeptide
QRFVTGHFGGLYPANGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1043 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1044 - protein, 570 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1045 - protein, 570 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1046 - protein, 570 aa, Artificial Sequence
  Synthetic polypeptide
QRFVTGHFGGLYPANGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1047 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1048 - protein, 570 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1049 - protein, 571 aa, Artificial Sequence
  Synthetic polypeptide
QRFVTGHFGGLYPANGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1050 - protein, 570 aa, Artificial Sequence; identical to SEQ ID NO: 1045
  Synthetic polypeptide

SEQ ID NO: 1051 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1052 - protein, 571 aa, Artificial Sequence
  Synthetic polypeptide
QRFVTGHFGGLYPANGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1053 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1054 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1055 - protein, 571 aa, Artificial Sequence
  Synthetic polypeptide
QRFVTGHFGGLYPANGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1056 - protein, 570 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1057 - protein, 571 aa, Artificial Sequence
  Synthetic polypeptide
QRFVTGHFGGLYPANGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1058 - protein, 576 aa, Artificial Sequence
  Synthetic polypeptide
QRFVTGHFGGLYPANGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1059 - protein, 570 aa, Artificial Sequence
  Synthetic polypeptide
QRFVTGHFGGLYPANGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1060 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1061 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1062 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1063 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1064 - protein, 571 aa, Artificial Sequence
  Synthetic polypeptide
QRFVTGHFGGLYPANGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1065 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1066 - protein, 571 aa, Artificial Sequence
  Synthetic polypeptide
QRFVTGHFGGLYPANGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1067 - protein, 571 aa, Artificial Sequence
  Synthetic polypeptide
QRFVTGHFGGLYPANGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1068 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1069 - protein, 571 aa, Artificial Sequence
  Synthetic polypeptide
QRFVTGHFGGLYPANGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1070 - protein, 571 aa, Artificial Sequence
  Synthetic polypeptide
QRFVTGHFGGLYPANGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1071 - protein, 571 aa, Artificial Sequence
  Synthetic polypeptide
QRFVTGHFGGLYPANGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1072 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1073 - protein, 571 aa, Artificial Sequence
  Synthetic polypeptide
QRFVTGHFGGLYPANGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1074 - protein, 575 aa, Artificial Sequence
  Synthetic polypeptide
QRFVTGHFGGLYPANGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1075 - protein, 576 aa, Artificial Sequence
  Synthetic polypeptide
QRFVTGHFGGLYPANGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1076 - protein, 576 aa, Artificial Sequence
  Synthetic polypeptide
QRFVTGHFGGLYPANGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1077 - protein, 576 aa, Artificial Sequence
  Synthetic polypeptide
QRFVTGHFGGLYPANGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1078 - protein, 573 aa, Artificial Sequence
  Synthetic polypeptide
QRFVTGHFGGLYPANGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1079 - protein, 574 aa, Artificial Sequence
  Synthetic polypeptide
QRFVTGHFGGLYPANGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1080 - protein, 574 aa, Artificial Sequence
  Synthetic polypeptide
QRFVTGHFGGLYPANGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1081 - protein, 574 aa, Artificial Sequence
  Synthetic polypeptide
QRFVTGHFGGLYPANGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1082 - protein, 628 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1083 - protein, 625 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1084 - protein, 625 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1085 - protein, 625 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1086 - protein, 625 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1087 - protein, 625 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1088 - protein, 625 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1089 - protein, 624 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1090 - protein, 625 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1091 - protein, 624 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1092 - protein, 624 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1093 - protein, 624 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1094 - protein, 625 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1095 - protein, 624 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1096 - protein, 625 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1097 - protein, 624 aa, Artificial Sequence; identical to SEQ ID NO: 1092
  Synthetic polypeptide

SEQ ID NO: 1098 - protein, 625 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1099 - protein, 625 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1100 - protein, 625 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1101 - protein, 625 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1102 - protein, 625 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1103 - protein, 624 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1104 - protein, 625 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1105 - protein, 630 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1106 - protein, 624 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1107 - protein, 625 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1108 - protein, 625 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1109 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1110 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1111 - protein, 625 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1112 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1113 - protein, 625 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1114 - protein, 625 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1115 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1116 - protein, 625 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1117 - protein, 625 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1118 - protein, 625 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1119 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1120 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1121 - protein, 629 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1122 - protein, 630 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1123 - protein, 630 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1124 - protein, 630 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1125 - protein, 627 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1126 - protein, 628 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1127 - protein, 628 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1128 - protein, 628 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSHHHHHH

SEQ ID NO: 1129 - protein, 628 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1130 - protein, 625 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1131 - protein, 625 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1132 - protein, 625 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1133 - protein, 625 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1134 - protein, 625 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1135 - protein, 625 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1136 - protein, 624 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1137 - protein, 625 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1138 - protein, 624 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1139 - protein, 624 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1140 - protein, 624 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1141 - protein, 625 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1142 - protein, 624 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1143 - protein, 625 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1144 - protein, 624 aa, Artificial Sequence; identical to SEQ ID NO: 1139
  Synthetic polypeptide

SEQ ID NO: 1145 - protein, 625 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1146 - protein, 625 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1147 - protein, 625 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1148 - protein, 625 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1149 - protein, 625 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1150 - protein, 624 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1151 - protein, 625 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1152 - protein, 630 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1153 - protein, 624 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1154 - protein, 625 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1155 - protein, 625 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1156 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1157 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1158 - protein, 625 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1159 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1160 - protein, 625 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1161 - protein, 625 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1162 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1163 - protein, 625 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1164 - protein, 625 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1165 - protein, 625 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1166 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1167 - protein, 625 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1168 - protein, 629 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1169 - protein, 630 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1170 - protein, 630 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1171 - protein, 630 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1172 - protein, 627 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1173 - protein, 628 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1174 - protein, 628 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1175 - protein, 628 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEVQLLESGGGLVQPGGSLRLSCAASGFTFRSFGMSWVRQAPGKGPEWVSSISGSGSDTLYADSVKGRFTISRDNSKNTLYLQMNSLRPEDTAVYYCTIGGSLSRSSQGTLVTVSSHHHHHH

SEQ ID NO: 1176 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1177 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1178 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1179 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1180 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1181 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1182 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1183 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1184 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1185 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1186 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1187 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1188 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1189 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1190 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1191 - protein, 1094 aa, Artificial Sequence; identical to SEQ ID NO: 1186
  Synthetic polypeptide

SEQ ID NO: 1192 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1193 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1194 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1195 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1196 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1197 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1198 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1199 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1200 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1201 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1202 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1203 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1204 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1205 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1206 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1207 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1208 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1209 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1210 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1211 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1212 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1213 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1214 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1215 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1216 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1217 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1218 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1219 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1220 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1221 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1222 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGDGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1223 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1224 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1225 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1226 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1227 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1228 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1229 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1230 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1231 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1232 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1233 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1234 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1235 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1236 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1237 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1238 - protein, 1094 aa, Artificial Sequence; identical to SEQ ID NO: 1233
  Synthetic polypeptide

SEQ ID NO: 1239 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1240 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1241 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1242 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1243 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1244 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1245 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1246 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1247 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1248 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1249 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1250 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1251 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1252 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1253 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1254 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1255 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1256 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1257 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1258 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1259 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1260 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1261 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1262 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1263 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1264 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1265 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1266 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1267 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1268 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1269 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1270 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1271 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1272 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1273 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1274 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1275 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1276 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1277 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1278 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1279 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1280 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1281 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1282 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1283 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1284 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1285 - protein, 1094 aa, Artificial Sequence; identical to SEQ ID NO: 1280
  Synthetic polypeptide

SEQ ID NO: 1286 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1287 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1288 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1289 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1290 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1291 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1292 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1293 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1294 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1295 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1296 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1297 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1298 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1299 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1300 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1301 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1302 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1303 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1304 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1305 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1306 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1307 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1308 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1309 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1310 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1311 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1312 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1313 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1314 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1315 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1316 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGLHHHHHH

SEQ ID NO: 1317 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1318 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1319 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1320 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1321 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1322 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1323 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1324 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1325 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1326 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1327 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1328 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1329 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1330 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1331 - protein, 1095 aa, Artificial Sequence [sequence omitted]

SEQ ID NO: 1332 - protein, 1094 aa, Artificial Sequence; identical to SEQ ID NO: 1327
  Synthetic polypeptide

SEQ ID NO: 1333 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1334 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1335 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1336 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1337 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1338 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1339 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1340 - protein, 1100 aa, Artificial Sequence [sequence omitted]

SEQ ID NO: 1341 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1342 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1343 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1344 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1345 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1346 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1347 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1348 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1349 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1350 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1351 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1352 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1353 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1354 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1355 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1356 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1357 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1358 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1359 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1360 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1361 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1362 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1363 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGLHHHHHH

SEQ ID NO: 1364 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1365 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1366 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1367 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1368 - protein, 1095 aa, Artificial Sequence [sequence omitted]

SEQ ID NO: 1369 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1370 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1371 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1372 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1373 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1374 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1375 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1376 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1377 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1378 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1379 - protein, 1094 aa, Artificial Sequence; identical to SEQ ID NO: 1374
  Synthetic polypeptide

SEQ ID NO: 1380 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1381 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1382 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1383 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1384 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1385 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1386 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1387 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1388 - protein, 1094 aa, Artificial Sequence [sequence omitted]

SEQ ID NO: 1389 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1390 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1391 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1392 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1393 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1394 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1395 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1396 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1397 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1398 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1399 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1400 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1401 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1402 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1403 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1404 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1405 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1406 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1407 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1408 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1409 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1410 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1411 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1412 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1413 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1414 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1415 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1416 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1417 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1418 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1419 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1420 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1421 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1422 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1423 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1424 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1425 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1426 - protein, 1094 aa, Artificial Sequence; identical to SEQ ID NO: 1421
  Synthetic polypeptide

SEQ ID NO: 1427 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1428 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1429 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1430 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1431 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1432 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1433 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1434 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1435 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1436 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1437 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1438 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1439 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1440 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1441 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1442 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1443 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1444 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1445 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1446 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1447 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1448 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1449 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1450 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1451 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1452 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1453 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1454 - protein, 1097 aa, Artificial Sequence [sequence omitted]

SEQ ID NO: 1455 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1456 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1457 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1458 - protein, 549 aa, Artificial Sequence
  Synthetic polypeptide
QRFCTGHFGGLHPCNGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1459 - protein, 546 aa, Artificial Sequence
  Synthetic polypeptide
QRFCTGHFGGLHPCNGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1460 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1461 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1462 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1463 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1464 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1465 - protein, 545 aa, Artificial Sequence
  Synthetic polypeptide
QRFCTGHFGGLHPCNGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1466 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1467 - protein, 545 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1468 - protein, 545 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1469 - protein, 545 aa, Artificial Sequence
  Synthetic polypeptide
QRFCTGHFGGLHPCNGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1470 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1471 - protein, 545 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1472 - protein, 546 aa, Artificial Sequence
  Synthetic polypeptide
QRFCTGHFGGLHPCNGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1473 - protein, 545 aa, Artificial Sequence; identical to SEQ ID NO: 1468
  Synthetic polypeptide

SEQ ID NO: 1474 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1475 - protein, 546 aa, Artificial Sequence
  Synthetic polypeptide
QRFCTGHFGGLHPCNGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1476 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1477 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1478 - protein, 546 aa, Artificial Sequence
  Synthetic polypeptide
QRFCTGHFGGLHPCNGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1479 - protein, 545 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1480 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1481 - protein, 551 aa, Artificial Sequence
  Synthetic polypeptide
QRFCTGHFGGLHPCNGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1482 - protein, 545 aa, Artificial Sequence
  Synthetic polypeptide
QRFCTGHFGGLHPCNGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1483 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1484 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1485 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1486 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1487 - protein, 546 aa, Artificial Sequence
  Synthetic polypeptide
QRFCTGHFGGLHPCNGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1488 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1489 - protein, 546 aa, Artificial Sequence
  Synthetic polypeptide
QRFCTGHFGGLHPCNGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1490 - protein, 546 aa, Artificial Sequence
  Synthetic polypeptide
QRFCTGHFGGLHPCNGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1491 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1492 - protein, 546 aa, Artificial Sequence
  Synthetic polypeptide
QRFCTGHFGGLHPCNGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1493 - protein, 546 aa, Artificial Sequence
  Synthetic polypeptide
QRFCTGHFGGLHPCNGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1494 - protein, 546 aa, Artificial Sequence
  Synthetic polypeptide
QRFCTGHFGGLHPCNGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1495 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1496 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1497 - protein, 550 aa, Artificial Sequence
  Synthetic polypeptide
QRFCTGHFGGLHPCNGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1498 - protein, 551 aa, Artificial Sequence
  Synthetic polypeptide
QRFCTGHFGGLHPCNGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1499 - protein, 551 aa, Artificial Sequence
  Synthetic polypeptide
QRFCTGHFGGLHPCNGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1500 - protein, 551 aa, Artificial Sequence
  Synthetic polypeptide
QRFCTGHFGGLHPCNGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1501 - protein, 548 aa, Artificial Sequence
  Synthetic polypeptide
QRFCTGHFGGLHPCNGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1502 - protein, 549 aa, Artificial Sequence
  Synthetic polypeptide
QRFCTGHFGGLHPCNGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1503 - protein, 549 aa, Artificial Sequence
  Synthetic polypeptide
QRFCTGHFGGLHPCNGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1504 - protein, 549 aa, Artificial Sequence
  Synthetic polypeptide
QRFCTGHFGGLHPCNGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGHHHHHH

SEQ ID NO: 1505 - protein, 549 aa, Artificial Sequence
  Synthetic polypeptide
QRFCTGHFGGLHPCNGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1506 - protein, 546 aa, Artificial Sequence
  Synthetic polypeptide
QRFCTGHFGGLHPCNGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1507 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1508 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1509 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1510 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1511 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1512 - protein, 545 aa, Artificial Sequence
  Synthetic polypeptide
QRFCTGHFGGLHPCNGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1513 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1514 - protein, 545 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1515 - protein, 545 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1516 - protein, 545 aa, Artificial Sequence
  Synthetic polypeptide
QRFCTGHFGGLHPCNGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1517 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1518 - protein, 545 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1519 - protein, 546 aa, Artificial Sequence
  Synthetic polypeptide
QRFCTGHFGGLHPCNGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1520 - protein, 545 aa, Artificial Sequence; identical to SEQ ID NO: 1515
  Synthetic polypeptide

SEQ ID NO: 1521 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1522 - protein, 546 aa, Artificial Sequence
  Synthetic polypeptide
QRFCTGHFGGLHPCNGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1523 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1524 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1525 - protein, 546 aa, Artificial Sequence
  Synthetic polypeptide
QRFCTGHFGGLHPCNGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1526 - protein, 545 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1527 - protein, 546 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1528 - protein, 551 aa, Artificial Sequence
  Synthetic polypeptide
QRFCTGHFGGLHPCNGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1529 - protein, 545 aa, Artificial Sequence
  Synthetic polypeptide
QRFCTGHFGGLHPCNGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1530 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1531 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1532 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1533 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1534 - protein, 546 aa, Artificial Sequence
  Synthetic polypeptide
QRFCTGHFGGLHPCNGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1535 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1536 - protein, 546 aa, Artificial Sequence
  Synthetic polypeptide
QRFCTGHFGGLHPCNGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1537 - protein, 546 aa, Artificial Sequence
  Synthetic polypeptide
QRFCTGHFGGLHPCNGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1538 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1539 - protein, 546 aa, Artificial Sequence
  Synthetic polypeptide
QRFCTGHFGGLHPCNGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1540 - protein, 546 aa, Artificial Sequence
  Synthetic polypeptide
QRFCTGHFGGLHPCNGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1541 - protein, 546 aa, Artificial Sequence
  Synthetic polypeptide
QRFCTGHFGGLHPCNGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1542 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1543 - protein, 546 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1544 - protein, 550 aa, Artificial Sequence
  Synthetic polypeptide
QRFCTGHFGGLHPCNGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1545 - protein, 551 aa, Artificial Sequence
  Synthetic polypeptide
QRFCTGHFGGLHPCNGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1546 - protein, 551 aa, Artificial Sequence
  Synthetic polypeptide
QRFCTGHFGGLHPCNGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1547 - protein, 551 aa, Artificial Sequence
  Synthetic polypeptide
QRFCTGHFGGLHPCNGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1548 - protein, 548 aa, Artificial Sequence
  Synthetic polypeptide
QRFCTGHFGGLHPCNGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1549 - protein, 549 aa, Artificial Sequence
  Synthetic polypeptide
QRFCTGHFGGLHPCNGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1550 - protein, 549 aa, Artificial Sequence
  Synthetic polypeptide
QRFCTGHFGGLHPCNGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1551 - protein, 549 aa, Artificial Sequence
  Synthetic polypeptide
QRFCTGHFGGLHPCNGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGHHHHHH

SEQ ID NO: 1552 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1553 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1554 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1555 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1556 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1557 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1558 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1559 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1560 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1561 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1562 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1563 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1564 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1565 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1566 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1567 - protein, 1094 aa, Artificial Sequence; identical to SEQ ID NO: 1562
  Synthetic polypeptide

SEQ ID NO: 1568 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1569 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1570 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1571 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1572 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1573 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1574 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1575 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1576 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1577 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1578 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1579 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1580 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1581 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1582 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1583 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1584 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1585 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1586 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1587 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1588 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1589 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1590 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1591 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1592 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1593 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1594 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1595 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1596 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1597 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1598 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGLHHHHHH

SEQ ID NO: 1599 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1600 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1601 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1602 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1603 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1604 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1605 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1606 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1607 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1608 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1609 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1610 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1611 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1612 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1613 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1614 - protein, 1094 aa, Artificial Sequence; identical to SEQ ID NO: 1609
  Synthetic polypeptide

SEQ ID NO: 1615 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1616 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1617 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1618 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1619 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1620 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1621 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1622 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1623 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1624 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1625 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1626 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1627 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1628 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1629 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1630 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1631 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1632 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1633 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1634 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1635 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1636 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1637 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1638 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1639 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1640 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1641 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1642 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1643 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1644 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1645 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGLHHHHHH

SEQ ID NO: 1646 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1647 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1648 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1649 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1650 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1651 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1652 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1653 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1654 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1655 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1656 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1657 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1658 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1659 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1660 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1661 - protein, 1094 aa, Artificial Sequence; identical to SEQ ID NO: 1656
  Synthetic polypeptide

SEQ ID NO: 1662 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1663 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1664 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1665 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1666 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1667 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1668 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1669 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1670 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1671 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1672 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1673 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1674 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1675 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1676 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1677 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1678 - protein, 1095 aa, Artificial Sequence [sequence omitted]

SEQ ID NO: 1679 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1680 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1681 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1682 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1683 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1684 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1685 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1686 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1687 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1688 - protein, 1100 aa, Artificial Sequence [sequence omitted]

SEQ ID NO: 1689 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1690 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1691 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1692 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGLHHHHHH

SEQ ID NO: 1693 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1694 - protein, 1095 aa, Artificial Sequence
  Synthetic polypeptide
QVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1695 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1696 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1697 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1698 - protein, 1095 aa, Artificial Sequence
  Synthetic polypeptide
QVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1699 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1700 - protein, 1094 aa, Artificial Sequence
  Synthetic polypeptide
QVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1701 - protein, 1095 aa, Artificial Sequence
  Synthetic polypeptide
QVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1702 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1703 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1704 - protein, 1094 aa, Artificial Sequence
  Synthetic polypeptide
QVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1705 - protein, 1095 aa, Artificial Sequence
  Synthetic polypeptide
QVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1706 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1707 - protein, 1095 aa, Artificial Sequence
  Synthetic polypeptide
QVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1708 - protein, 1094 aa, Artificial Sequence; identical to SEQ ID NO: 1703
  Synthetic polypeptide

SEQ ID NO: 1709 - protein, 1095 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1710 - protein, 1095 aa, Artificial Sequence
  Synthetic polypeptide
QVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1711 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1712 - protein, 1095 aa, Artificial Sequence
  Synthetic polypeptide
QVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1713 - protein, 1095 aa, Artificial Sequence
  Synthetic polypeptide
QVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1714 - protein, 1094 aa, Artificial Sequence
  Synthetic polypeptide
QVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1715 - protein, 1095 aa, Artificial Sequence
  Synthetic polypeptide
QVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1716 - protein, 1100 aa, Artificial Sequence
  Synthetic polypeptide
QVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1717 - protein, 1094 aa, Artificial Sequence
  Synthetic polypeptide
QVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1718 - protein, 1095 aa, Artificial Sequence
  Synthetic polypeptide
QVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1719 - protein, 1095 aa, Artificial Sequence
  Synthetic polypeptide
QVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1720 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1721 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1722 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1723 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1724 - protein, 1095 aa, Artificial Sequence
  Synthetic polypeptide
QVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1725 - protein, 1095 aa, Artificial Sequence
  Synthetic polypeptide
QVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1726 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1727 - protein, 1095 aa, Artificial Sequence
  Synthetic polypeptide
QVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1728 - protein, 1095 aa, Artificial Sequence
  Synthetic polypeptide
QVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1729 - protein, 1095 aa, Artificial Sequence
  Synthetic polypeptide
QVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1730 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1731 - protein, 1095 aa, Artificial Sequence
  Synthetic polypeptide
QVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1732 - protein, 1099 aa, Artificial Sequence
  Synthetic polypeptide
QVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1733 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1734 - protein, 1100 aa, Artificial Sequence
  Synthetic polypeptide
QVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1735 - protein, 1100 aa, Artificial Sequence
  Synthetic polypeptide
QVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1736 - protein, 1097 aa, Artificial Sequence
  Synthetic polypeptide
QVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1737 - protein, 1098 aa, Artificial Sequence
  Synthetic polypeptide
QVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1738 - protein, 1098 aa, Artificial Sequence
  Synthetic polypeptide
QVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1739 - protein, 1098 aa, Artificial Sequence
  Synthetic polypeptide
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGLHHHHHH

SEQ ID NO: 1740 - protein, 574 aa, Artificial Sequence
  Synthetic polypeptide
QRFCTGHFGGLHPCNGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1741 - protein, 571 aa, Artificial Sequence
  Synthetic polypeptide
QRFCTGHFGGLHPCNGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1742 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1743 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1744 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1745 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1746 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1747 - protein, 570 aa, Artificial Sequence
  Synthetic polypeptide
QRFCTGHFGGLHPCNGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1748 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1749 - protein, 570 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1750 - protein, 570 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1751 - protein, 570 aa, Artificial Sequence
  Synthetic polypeptide
QRFCTGHFGGLHPCNGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1752 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1753 - protein, 570 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1754 - protein, 571 aa, Artificial Sequence
  Synthetic polypeptide
QRFCTGHFGGLHPCNGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1755 - protein, 570 aa, Artificial Sequence; identical to SEQ ID NO: 1750
  Synthetic polypeptide

SEQ ID NO: 1756 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1757 - protein, 571 aa, Artificial Sequence
  Synthetic polypeptide
QRFCTGHFGGLHPCNGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1758 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1759 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1760 - protein, 571 aa, Artificial Sequence
  Synthetic polypeptide
QRFCTGHFGGLHPCNGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1761 - protein, 570 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1762 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1763 - protein, 576 aa, Artificial Sequence
  Synthetic polypeptide
QRFCTGHFGGLHPCNGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1764 - protein, 570 aa, Artificial Sequence
  Synthetic polypeptide
QRFCTGHFGGLHPCNGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1765 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1766 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1767 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1768 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1769 - protein, 571 aa, Artificial Sequence
  Synthetic polypeptide
QRFCTGHFGGLHPCNGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1770 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1771 - protein, 571 aa, Artificial Sequence
  Synthetic polypeptide
QRFCTGHFGGLHPCNGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1772 - protein, 571 aa, Artificial Sequence
  Synthetic polypeptide
QRFCTGHFGGLHPCNGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1773 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1774 - protein, 571 aa, Artificial Sequence
  Synthetic polypeptide
QRFCTGHFGGLHPCNGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1775 - protein, 571 aa, Artificial Sequence
  Synthetic polypeptide
QRFCTGHFGGLHPCNGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1776 - protein, 571 aa, Artificial Sequence
  Synthetic polypeptide
QRFCTGHFGGLHPCNGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1777 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1778 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1779 - protein, 575 aa, Artificial Sequence
  Synthetic polypeptide
QRFCTGHFGGLHPCNGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1780 - protein, 576 aa, Artificial Sequence
  Synthetic polypeptide
QRFCTGHFGGLHPCNGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1781 - protein, 576 aa, Artificial Sequence
  Synthetic polypeptide
QRFCTGHFGGLHPCNGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1782 - protein, 576 aa, Artificial Sequence
  Synthetic polypeptide
QRFCTGHFGGLHPCNGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1783 - protein, 573 aa, Artificial Sequence
  Synthetic polypeptide
QRFCTGHFGGLHPCNGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1784 - protein, 574 aa, Artificial Sequence
  Synthetic polypeptide
QRFCTGHFGGLHPCNGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1785 - protein, 574 aa, Artificial Sequence
  Synthetic polypeptide
QRFCTGHFGGLHPCNGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1786 - protein, 574 aa, Artificial Sequence
  Synthetic polypeptide
QRFCTGHFGGLHPCNGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLHPANGGGGGSGGGSRDWDFDVFGGGTPVGGHHHHHH

SEQ ID NO: 1787 - protein, 574 aa, Artificial Sequence
  Synthetic polypeptide
QRFCTGHFGGLHPCNGGGGGSQVQLVESGGGVVQPGGSLRLSCAASGFTFSSYGMHWVRQAPGKGLEWVAFIWYDGSNKYYADSVKGRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1788 - protein, 571 aa, Artificial Sequence
  Synthetic polypeptide
QRFCTGHFGGLHPCNGGGGGSQVQLQESGPGLVKPSQTLSLTCTVSGGSISRGGYYWSWIRQHPGKGLEWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQFPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1789 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGTSNRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1790 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1791 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLRSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1792 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYSGSTFYNPSLRSRVTISVDTSKNQFSLKLSSVTAADTAVYYCARDSSSSRALDYWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDSSPRTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1793 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1794 - protein, 570 aa, Artificial Sequence
  Synthetic polypeptide
QRFCTGHFGGLHPCNGGGGGSQVQLQESGPGLVKPSETLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1795 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1796 - protein, 570 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1797 - protein, 570 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1798 - protein, 570 aa, Artificial Sequence
  Synthetic polypeptide
QRFCTGHFGGLHPCNGGGGGSQVQLQESGPGLVKPSQTLSLTCTISGGSISSGGYYWSWIRQHPGKGLEWIGYIFYSGRTYYNPSLKSRVTISVDTSKNQFSLKLTSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1799 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLDWIGYIFYRGRTYYNPSLKSRVTISVDTSKNQFSLKLSSVTAADTAVYYCARVNSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1800 - protein, 570 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGSSPSFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1801 - protein, 571 aa, Artificial Sequence
  Synthetic polypeptide
QRFCTGHFGGLHPCNGGGGGSQVQLQESGPGLVRPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYDTSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1802 - protein, 570 aa, Artificial Sequence; identical to SEQ ID NO: 1797
  Synthetic polypeptide

SEQ ID NO: 1803 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1804 - protein, 571 aa, Artificial Sequence
  Synthetic polypeptide
QRFCTGHFGGLHPCNGGGGGSQVQLQESGPGLVKPSQTLSLTCTVSGGSISSGGYYWSWVRQHPGKGLEWIGYIFYSGRTYYNPSLKSRVIISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1805 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1806 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGRTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1807 - protein, 571 aa, Artificial Sequence
  Synthetic polypeptide
QRFCTGHFGGLHPCNGGGGGSQVQLQESGPGLVKPSETLSLTCTVSGGSVSSGGYYWSWIRQPPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1808 - protein, 570 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIYYRGRTYYNPSLKSRVTISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1809 - protein, 571 aa, Artificial Sequence
  Synthetic polypeptide
QRFCTGHFGGLHPCNGGGGGSQVQLQESGPGLVKPSQTLSLTCTVSGGSISSGGYYWSWIRQHPGKGLEWIGYIFYSGKTYYNPSLKSRVSISVDTSKNQFSLKLSSVTAADTAVYYCARVYSNYGWFDPWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1810 - protein, 576 aa, Artificial Sequence
  Synthetic polypeptide
QRFCTGHFGGLHPCNGGGGGSQVQLQESGPGLVKPSETLSLTCTVSGGSISSYYWSWIRQPPGKGLEWIGYIYYSGSTNYNPSLKSRVTMSIDTSKNQFSLKLISVTAADTAVYYCARDQRRIVAAGGYYYGMDVWGQGTTVTVSSGGGGSGGGGSGGGGSEIVLTQSPGTLSLSPGERATLSCRASQSVSSSYLAWYQQKPGQAPRLLIYGASTRATGIPARFSGSGSGTDFTLTISRLEPEDFAVYYCQQYGSSPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1811 - protein, 570 aa, Artificial Sequence
  Synthetic polypeptide
QRFCTGHFGGLHPCNGGGGGSQVQLQESGPGLVKPSQTLSLTCTVSGGSISSNDYYWSWIRQHPGKGLEWIGYIYYSGSTFYNPSLKSRGAISVDTSKNQFSLKLTSVTAADTAVYYCARGVYRTGAFDIWGQGTMVTVSSGGGGSGGGGSGGGGSDIQMTQSPSSLSASVGDRVTITCRASQSISSYLNWYQQKPGKAPKSLIYAASSLQSGVPSKFSGSGSGTDFTLTISSLQPEDIATYYCQQSYSTPQAFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1812 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYGGETNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1813 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYSGATNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1814 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSNGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1815 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGEPASISCRSSQSLLHSVGYNYLDWYLQKPGQSPQLLIYLGSYRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1816 - protein, 571 aa, Artificial Sequence
  Synthetic polypeptide
QRFCTGHFGGLHPCNGGGGGSQVQLVQSGAEVKKPGASVKVSCKASGYTFTSYGISWVRQAPGQGLEWMGWINPYTGNRNYAQKVQDRVTMTTDTSTNTAYMELSSLRSDDTAVYYCARGSGGFDYWGQGTLVTVSSGGGGSGGGGSGGGGSDIVMTQSPLSLPVTLGQPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1817 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQDRVTMTTDTSTNTAYMELRSLRSDDTAVYYCARGSGGFDYWGQGTLVTVSSGGGGSGGGGSGGGGSDIVMTQTPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1818 - protein, 571 aa, Artificial Sequence
  Synthetic polypeptide
QRFCTGHFGGLHPCNGGGGGSQVQLVQSGAEVKKPGASVKVSCKASGYTFTTYGISWVRQAPGQGLEWMGWINPYTGKTNYAQKLQGRVTMATDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1819 - protein, 571 aa, Artificial Sequence
  Synthetic polypeptide
QRFCTGHFGGLHPCNGGGGGSQVQLVQSGAEVKEPGASVKVSCKASGYTFTYYGISWVRQAPGQGLEWMGWINPYTGNRNYAQKVQDRVTMTTDTSTNTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1820 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1821 - protein, 571 aa, Artificial Sequence
  Synthetic polypeptide
QRFCTGHFGGLHPCNGGGGGSQVQLVQSGAEVKKPGASVKVSCKASGYTFTSYGITWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLSVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1822 - protein, 571 aa, Artificial Sequence
  Synthetic polypeptide
QRFCTGHFGGLHPCNGGGGGSQVQLVQSGAEVKKPGASVKVSCKASGYTFTSYGISWVRQAPGQGLEWMGWINPYTGNRNYAQKFQGRVTMTTDTSTNTAYMELSSLRSEDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1823 - protein, 571 aa, Artificial Sequence
  Synthetic polypeptide
QRFCTGHFGGLHPCNGGGGGSQVQLVQSGAEVKKPGASVKVSCKASGYSFTSYGISWVRQAPGQGLEWMGWINPYTGNRNYAQKVQGRVTMTTDTSTSTAYMELRSLRSDDTAVYYCARGSGGFDYWGQGTLVTVSSGGGGSGGGGSGGGGSDIVMTQSPLSLPVTPGEPASISCRSSQSLLHSVGYNYLDWYLQKPGQSPQLLIYLGSNRASGVPDRFSGSGSGTDFTLKISRVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1824 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKVQGRVTMTTDTSTSTAYMELRNLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1825 - protein, 571 aa, Artificial Sequence
  Synthetic polypeptide
QRFCTGHFGGLHPCNGGGGGSQVQLVQSGAEVKKPGASVKVSCKASGYTFTYYGISWVRQAPGQGLEWMGWINPYTGKTNYAQKLQGRVTMTTDTSTSTAYMELRSLRSDDTAVYYCARGSGGFDYWGQGTLVTVSSGGGGSGGGGSGGGGSDIVMTQTPLSLSVTPGQPASISCRSSQSLLHSVGYNYLDWYLQKPGQSPQLLIYLGSNRASGVPDRFSGSGSGTDFTLKISRVEAEDVGVYYCMQALQTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1826 - protein, 575 aa, Artificial Sequence
  Synthetic polypeptide
QRFCTGHFGGLHPCNGGGGGSQVQLVESGGGVVQPGRSLRLSCAASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1827 - protein, 576 aa, Artificial Sequence
  Synthetic polypeptide
QRFCTGHFGGLHPCNGGGGGSQVQLVESGGGVVQPGRSLRLSCVASGFTFRNYAMHWVRQAPGKGLEWVAVISYSGNNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCRASQSISSYLNWYQQKPGKAPKLLIYDASSLQSGVPSRFSGSGSGTEFTLTISSLQAEDVAVYYCQQYYSTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1828 - protein, 576 aa, Artificial Sequence
  Synthetic polypeptide
QRFCTGHFGGLHPCNGGGGGSQVQLVESGGGVVQPGRSLRLSCAASGFTFRNYAMHWVRQAPGKGLEWVAGISYSGTNKYYASSVKGRFTISRDNSKNTLYLQLNSLRAEDTAVYYCAREFYYDSTGYDYSTPGDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTEFTLTISSLQPEDIATYYCQQYDNLPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1829 - protein, 576 aa, Artificial Sequence
  Synthetic polypeptide
QRFCTGHFGGLHPCNGGGGGSQVQLVESGGGVVQPGRSLRLSCVASGFTFRNYAMHWVRQAPGKGLEWVAVISYSGNNKYYASSVKGRFTISRDNSKNTLFLQLNSLRAEDTAVYYCAREFYYDSTGYDYSTPGNYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYVNLPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1830 - protein, 573 aa, Artificial Sequence
  Synthetic polypeptide
QRFCTGHFGGLHPCNGGGGGSQVQLVESGGGVVQPGRSLRLSCAASGFTFSSYGMQWVRQAPGKGLEWVAVIWYSGSNKYYASSVKGRFTISRDNSKNTLYLQMNSLRAEDTAVYYCARDGYPIFYRYYGMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1831 - protein, 574 aa, Artificial Sequence
  Synthetic polypeptide
QRFCTGHFGGLHPCNGGGGGSQVQLVESGGGVVQPGRSLRLSCAASGFTFSSYGMHWVRQAPGKGLEWVAVISYSGSNKYYASSVKGRFTISRDNSKNTLYLQMNSLRAEDTAVYYCARDGYPIFYRYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDLAVYYCQQYGTSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1832 - protein, 574 aa, Artificial Sequence
  Synthetic polypeptide
QRFCTGHFGGLHPCNGGGGGSQVQLVESGGGVVQPGRSLRLSCAASGFTFSSFGMHWVRQAPGKGLEWVAFIWYSGSNKYYASSVKGRVTISRDNSKNTLYLQMNSLRAEDTAVYYCARDGYPIFYYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1833 - protein, 574 aa, Artificial Sequence
  Synthetic polypeptide
QRFCTGHFGGLHPCNGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFVTGHFGGLYPANGGGGGSGGGSRDWDFDVFGGGTPVGGHHHHHH

SEQ ID NO: 1834 - protein, 772 aa, Homo sapiens
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 1835 - protein, 772 aa, Macaca fascicularis
MNCYLLLPFMLGIPLLWPCLGATENSQTKKVQQPVGSHLRVKRGWVWNQFFVPEEMNTTSHHVGRLRSDLDNGNNSFQYKLLGAGAGSTFIIDERTGDIYAIEKLDREERSLYILRAQVIDITTGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVNFEHQNHYGIRAKVKNHHVDEQLMKYHTEASTTFIKIQVEDVDEPPLFLLPYYIFEIFEETPQGSFVGVVSATDPDNRKSPIRYSITRSKVFNIDDNGTITTTNSLDREISAWYNLSITATEKYNIEQISSIPVYVQVLNINDHAPEFSQYYESYVCENAGSGQVIQTISAVDRDESIEEHHFYFNLSVEDTNSSSFTIIDNQDNTAVILTNRTGFNLQEEPIFYISILIADNGIPSLTSTNTLTIHVCDCDDSGSTQTCQYQELMLSMGFKTEVIIAILICIMVIFGFIFLTLGLKQRRKQILFPEKSEDFRENIFRYDDEGGGEEDTEAFDVAALRSSTIMRERKTRKTTSAEIRSLYRQSLQVGPDSAIFRKFILEKLEEADTDPCAPPFDSLQTYAFEGTGSLAGSLSSLESAVSDQDESYDYLNELGPRFKRLACMFGSAVQSNN

SEQ ID NO: 1836 - protein, 596 aa, Homo sapiens
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTE

SEQ ID NO: 1837 - protein, 784 aa, Artificial Sequence
  Synthetic polypeptide
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 1838 - protein, 784 aa, Artificial Sequence
  Synthetic polypeptide
MNCYLLLRFMLGIPLLWPCLGATENSQTKKVKQPVRSHLRVKRDYKDDDDKGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 1839 - protein, 784 aa, Artificial Sequence
  Synthetic polypeptide
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 1840 - protein, 784 aa, Artificial Sequence
  Synthetic polypeptide
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 1841 - protein, 779 aa, Homo sapiens
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 1842 - protein, 785 aa, Homo sapiens
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 1843 - protein, 780 aa, Homo sapiens
MNCYLLLRFMLGIPLLWPCLGATENSQTKKVKQPVRSHLRVKRDYKDDDDKGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 1844 - protein, 105 aa, Homo sapiens
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 1845 - protein, 27 aa, Homo sapiens
QDGNEEMGGITQTPYKVSISGTTVILT

SEQ ID NO: 1846 - protein, 96 aa, Callithrix jacchus
QDGNEEMGDTTQNPYKVSISGTTVTLTCPRYDGHEIKWLVNSQNKEGHEDHLLLEDFSEMEQSGYYACLSKETPAEEASHYLYLKARVCENCVEVD

SEQ ID NO: 1847 - protein, 27 aa, Callithrix jacchus
QDGNEEMGDTTQNPYKVSISGTTVTLT

SEQ ID NO: 1848 - protein, 96 aa, Saguinus oedipus; identical to SEQ ID NO: 1846

SEQ ID NO: 1849 - protein, 27 aa, Saguinus oedipus
QDGNEEMGDTTQNPYKVSISGTTVTLT

SEQ ID NO: 1850 - protein, 96 aa, Saimiri sciureus
QDGNEEIGDTTQNPYKVSISGTTVTLTCPRYDGQEIKWLVNDQNKEGHEDHLLLEDFSEMEQSGYYACLSKETPTEEASHYLYLKARVCENCVEVD

SEQ ID NO: 1851 - protein, 27 aa, Saimiri sciureus
QDGNEEIGDTTQNPYKVSISGTTVTLT

The invention claimed is:

1. A bispecific antibody construct comprising a first human binding domain which binds to human CDH19 on the surface of a target cell and a second binding domain which binds to human CD3 on the surface of a T cell,
    wherein the first binding domain comprises a VH region comprising CDR-H1, CDR-H2 and CDR-H3 and a VL region comprising CDR-L1, CDR-L2 and CDR-L3 selected from the group consisting of:
    (a)(i) CDR-H1 as depicted in SEQ ID NO: 14, CDR-H2 as depicted in SEQ ID NO: 15, CDR-H3 as depicted in SEQ ID NO: 16, CDR-L1 as depicted in SEQ ID NO: 17, CDR-L2 as depicted in SEQ ID NO: 18 and CDR-L3 as depicted in SEQ ID NO: 19;
    (a)(ii) CDR-H1 as depicted in SEQ ID NO: 27, CDR-H2 as depicted in SEQ ID NO: 28, CDR-H3 as depicted in SEQ ID NO: 29, CDR-L1 as depicted in SEQ ID NO: 30, CDR-L2 as depicted in SEQ ID NO: 31 and CDR-L3 as depicted in SEQ ID NO: 32;
    (a)(iii) CDR-H1 as depicted in SEQ ID NO: 40, CDR-H2 as depicted in SEQ ID NO: 41, CDR-H3 as depicted in SEQ ID NO: 42, CDR-L1 as depicted in SEQ ID NO: 43, CDR-L2 as depicted in SEQ ID NO: 44 and CDR-L3 as depicted in SEQ ID NO: 45;
    (a)(iv) CDR-H1 as depicted in SEQ ID NO: 53, CDR-H2 as depicted in SEQ ID NO: 54, CDR-H3 as depicted in SEQ ID NO: 55, CDR-L1 as depicted in SEQ ID NO: 56, CDR-L2 as depicted in SEQ ID NO: 57 and CDR-L3 as depicted in SEQ ID NO: 58;
    (a)(v) CDR-H1 as depicted in SEQ ID NO: 66, CDR-H2 as depicted in SEQ ID NO: 67, CDR-H3 as depicted in SEQ ID NO: 68, CDR-L1 as depicted in SEQ ID NO: 69, CDR-L2 as depicted in SEQ ID NO: 70 and CDR-L3 as depicted in SEQ ID NO: 71;
    (a)(vi) CDR-H1 as depicted in SEQ ID NO: 79, CDR-H2 as depicted in SEQ ID NO: 80, CDR-H3 as depicted in SEQ ID NO: 81, CDR-L1 as depicted in SEQ ID NO: 82, CDR-L2 as depicted in SEQ ID NO: 83 and CDR-L3 as depicted in SEQ ID NO: 84;
    (a)(vii) CDR-H1 as depicted in SEQ ID NO: 92, CDR-H2 as depicted in SEQ ID NO: 93, CDR-H3 as depicted in SEQ ID NO: 94, CDR-L1 as depicted in SEQ ID NO: 95, CDR-L2 as depicted in SEQ ID NO: 96 and CDR-L3 as depicted in SEQ ID NO: 97;
    (a)(viii) CDR-H1 as depicted in SEQ ID NO: 105, CDR-H2 as depicted in SEQ ID NO: 106, CDR-H3 as depicted in SEQ ID NO: 107, CDR-L1 as depicted in SEQ ID NO: 108, CDR-L2 as depicted in SEQ ID NO: 109 and CDR-L3 as depicted in SEQ ID NO: 110;
    (a)(ix) CDR-H1 as depicted in SEQ ID NO: 118, CDR-H2 as depicted in SEQ ID NO: 119, CDR-H3 as depicted in SEQ ID NO: 120, CDR-L1 as depicted in SEQ ID NO: 121, CDR-L2 as depicted in SEQ ID NO: 122 and CDR-L3 as depicted in SEQ ID NO: 123;
    (a)(x) CDR-H1 as depicted in SEQ ID NO: 131, CDR-H2 as depicted in SEQ ID NO: 132, CDR-H3 as depicted in SEQ ID NO: 133, CDR-L1 as depicted in SEQ ID NO: 134, CDR-L2 as depicted in SEQ ID NO: 135 and CDR-L3 as depicted in SEQ ID NO: 136;
    (a)(xi) CDR-H1 as depicted in SEQ ID NO: 144, CDR-H2 as depicted in SEQ ID NO: 145, CDR-H3 as depicted in SEQ ID NO: 146, CDR-L1 as depicted in SEQ ID NO: 147, CDR-L2 as depicted in SEQ ID NO: 148 and CDR-L3 as depicted in SEQ ID NO: 149;

(a)(xii) CDR-H1 as depicted in SEQ ID NO: 157, CDR-H2 as depicted in SEQ ID NO: 158, CDR-H3 as depicted in SEQ ID NO: 159, CDR-L1 as depicted in SEQ ID NO: 160, CDR-L2 as depicted in SEQ ID NO: 161 and CDR-L3 as depicted in SEQ ID NO: 162, (a)(xiii) CDR-H1 as depicted in SEQ ID NO: 170, CDR-H2 as depicted in SEQ ID NO: 171, CDR-H3 as depicted in SEQ ID NO: 172, CDR-L1 as depicted in SEQ ID NO: 173, CDR-L2 as depicted in SEQ ID NO: 174 and CDR-L3 as depicted in SEQ ID NO: 175;

(a)(xiv) CDR-H1 as depicted in SEQ ID NO: 183, CDR-H2 as depicted in SEQ ID NO: 184, CDR-H3 as depicted in SEQ ID NO: 185, CDR-L1 as depicted in SEQ ID NO: 186, CDR-L2 as depicted in SEQ ID NO: 187 and CDR-L3 as depicted in SEQ ID NO: 188;

(a)(xv) CDR-H1 as depicted in SEQ ID NO: 196, CDR-H2 as depicted in SEQ ID NO: 197, CDR-H3 as depicted in SEQ ID NO: 198, CDR-L1 as depicted in SEQ ID NO: 199, CDR-L2 as depicted in SEQ ID NO: 200 and CDR-L3 as depicted in SEQ ID NO: 201;

(a)(xvi) CDR-H1 as depicted in SEQ ID NO: 209, CDR-H2 as depicted in SEQ ID NO: 210, CDR-H3 as depicted in SEQ ID NO: 211, CDR-L1 as depicted in SEQ ID NO: 212, CDR-L2 as depicted in SEQ ID NO: 213 and CDR-L3 as depicted in SEQ ID NO: 214;

(a)(xvii) CDR-H1 as depicted in SEQ ID NO: 222, CDR-H2 as depicted in SEQ ID NO: 223, CDR-H3 as depicted in SEQ ID NO: 224, CDR-L1 as depicted in SEQ ID NO: 225, CDR-L2 as depicted in SEQ ID NO: 226 and CDR-L3 as depicted in SEQ ID NO: 227;

(a)(xviii) CDR-H1 as depicted in SEQ ID NO: 235, CDR-H2 as depicted in SEQ ID NO: 236, CDR-H3 as depicted in SEQ ID NO: 237, CDR-L1 as depicted in SEQ ID NO: 238, CDR-L2 as depicted in SEQ ID NO: 239 and CDR-L3 as depicted in SEQ ID NO: 240;

(a)(xix) CDR-H1 as depicted in SEQ ID NO: 248, CDR-H2 as depicted in SEQ ID NO: 249, CDR-H3 as depicted in SEQ ID NO: 250, CDR-L1 as depicted in SEQ ID NO: 251, CDR-L2 as depicted in SEQ ID NO: 252 and CDR-L3 as depicted in SEQ ID NO: 253;

(a)(xx) CDR-H1 as depicted in SEQ ID NO: 261, CDR-H2 as depicted in SEQ ID NO: 262, CDR-H3 as depicted in SEQ ID NO: 263, CDR-L1 as depicted in SEQ ID NO: 264, CDR-L2 as depicted in SEQ ID NO: 265 and CDR-L3 as depicted in SEQ ID NO: 266;

(a)(xxi) CDR-H1 as depicted in SEQ ID NO: 274, CDR-H2 as depicted in SEQ ID NO: 275, CDR-H3 as depicted in SEQ ID NO: 276, CDR-L1 as depicted in SEQ ID NO: 277, CDR-L2 as depicted in SEQ ID NO: 278 and CDR-L3 as depicted in SEQ ID NO: 279;

(a)(xxii) CDR-H1 as depicted in SEQ ID NO: 287, CDR-H2 as depicted in SEQ ID NO: 288, CDR-H3 as depicted in SEQ ID NO: 289, CDR-L1 as depicted in SEQ ID NO: 290, CDR-L2 as depicted in SEQ ID NO: 291 and CDR-L3 as depicted in SEQ ID NO: 292;

(a)(xxiii) CDR-H1 as depicted in SEQ ID NO: 300, CDR-H2 as depicted in SEQ ID NO: 301, CDR-H3 as depicted in SEQ ID NO: 302, CDR-L1 as depicted in SEQ ID NO: 303, CDR-L2 as depicted in SEQ ID NO: 304 and CDR-L3 as depicted in SEQ ID NO: 305;

(a)(xxiv) CDR-H1 as depicted in SEQ ID NO: 313, CDR-H2 as depicted in SEQ ID NO: 314, CDR-H3 as depicted in SEQ ID NO: 315, CDR-L1 as depicted in SEQ ID NO: 316, CDR-L2 as depicted in SEQ ID NO: 317 and CDR-L3 as depicted in SEQ ID NO: 318;

(a)(xxv) CDR-H1 as depicted in SEQ ID NO: 508, CDR-H2 as depicted in SEQ ID NO: 509, CDR-H3 as depicted in SEQ ID NO: 510, CDR-L1 as depicted in SEQ ID NO: 511, CDR-L2 as depicted in SEQ ID NO: 512 and CDR-L3 as depicted in SEQ ID NO: 513;

(a)(xxvi) CDR-H1 as depicted in SEQ ID NO: 521, CDR-H2 as depicted in SEQ ID NO: 522, CDR-H3 as depicted in SEQ ID NO: 523, CDR-L1 as depicted in SEQ ID NO: 524, CDR-L2 as depicted in SEQ ID NO: 525 and CDR-L3 as depicted in SEQ ID NO: 526;

(a)(xxvii) CDR-H1 as depicted in SEQ ID NO: 534, CDR-H2 as depicted in SEQ ID NO: 535, CDR-H3 as depicted in SEQ ID NO: 536, CDR-L1 as depicted in SEQ ID NO: 537, CDR-L2 as depicted in SEQ ID NO: 538 and CDR-L3 as depicted in SEQ ID NO: 539;

(a)(xxviii) CDR-H1 as depicted in SEQ ID NO: 547, CDR-H2 as depicted in SEQ ID NO: 548, CDR-H3 as depicted in SEQ ID NO: 549, CDR-L1 as depicted in SEQ ID NO: 550, CDR-L2 as depicted in SEQ ID NO: 551 and CDR-L3 as depicted in SEQ ID NO: 552;

(a)(xxix) CDR-H1 as depicted in SEQ ID NO: 560, CDR-H2 as depicted in SEQ ID NO: 561, CDR-H3 as depicted in SEQ ID NO: 562, CDR-L1 as depicted in SEQ ID NO: 563, CDR-L2 as depicted in SEQ ID NO: 564 and CDR-L3 as depicted in SEQ ID NO: 565;

(a)(xxx) CDR-H1 as depicted in SEQ ID NO: 573, CDR-H2 as depicted in SEQ ID NO: 574, CDR-H3 as depicted in SEQ ID NO: 575, CDR-L1 as depicted in SEQ ID NO: 576, CDR-L2 as depicted in SEQ ID NO: 577 and CDR-L3 as depicted in SEQ ID NO: 578; and (a)(xxxi) CDR-H1 as depicted in SEQ ID NO: 586 CDR-H2 as depicted in SEQ ID NO: 587, CDR-H3 as depicted in SEQ ID NO: 588, CDR-L1 as depicted in SEQ ID NO: 589, CDR-L2 as depicted in SEQ ID NO: 590 and CDR-L3 as depicted in SEQ ID NO: 591; and (b)(i) CDR-H1 as depicted in SEQ ID NO: 1, CDR-H2 as depicted in SEQ ID NO: 2, CDR-H3 as depicted in SEQ ID NO: 3, CDR-L1 as depicted in SEQ ID NO: 4, CDR-L2 as depicted in SEQ ID NO: 5 and CDR-L3 as depicted in SEQ ID NO: 6;

(b)(ii) CDR-H1 as depicted in SEQ ID NO: 326, CDR-H2 as depicted in SEQ ID NO: 327, CDR-H3 as depicted in SEQ ID NO: 328, CDR-L1 as depicted in SEQ ID NO: 329, CDR-L2 as depicted in SEQ ID NO: 330 and CDR-L3 as depicted in SEQ ID NO: 331;

(b)(iii) CDR-H1 as depicted in SEQ ID NO: 339, CDR-H2 as depicted in SEQ ID NO: 340, CDR-H3 as depicted in SEQ ID NO: 341, CDR-L1 as depicted in SEQ ID NO: 342, CDR-L2 as depicted in SEQ ID NO: 343 and CDR-L3 as depicted in SEQ ID NO: 344, (b)(iv) CDR-H1 as depicted in SEQ ID NO: 352, CDR-H2 as depicted in SEQ ID NO: 353, CDR-H3 as depicted in SEQ ID NO: 354, CDR-L1 as depicted in SEQ ID NO: 355, CDR-L2 as depicted in SEQ ID NO: 356 and CDR-L3 as depicted in SEQ ID NO: 357;

(b)(v) CDR-H1 as depicted in SEQ ID NO: 365, CDR-H2 as depicted in SEQ ID NO: 366, CDR-H3 as depicted in SEQ ID NO: 367, CDR-L1 as depicted in SEQ ID NO: 368, CDR-L2 as depicted in SEQ ID NO: 369 and CDR-L3 as depicted in SEQ ID NO: 370;

(b)(vi) CDR-H1 as depicted in SEQ ID NO: 378, CDR-H2 as depicted in SEQ ID NO: 379, CDR-H3 as depicted in SEQ ID NO: 380, CDR-L1 as depicted in SEQ ID NO: 381, CDR-L2 as depicted in SEQ ID NO: 382 and CDR-L3 as depicted in SEQ ID NO: 383;

(b)(vii) CDR-H1 as depicted in SEQ ID NO: 391, CDR-H2 as depicted in SEQ ID NO: 392, CDR-H3 as depicted in SEQ ID NO: 393, CDR-L1 as depicted in SEQ ID NO: 394, CDR-L2 as depicted in SEQ ID NO: 395 and CDR-L3 as depicted in SEQ ID NO: 396;

(b)(viii) CDR-H1 as depicted in SEQ ID NO: 404, CDR-H2 as depicted in SEQ ID NO: 405, CDR-H3 as depicted in SEQ ID NO: 406, CDR-L1 as depicted in SEQ ID NO: 407, CDR-L2 as depicted in SEQ ID NO: 408 and CDR-L3 as depicted in SEQ ID NO: 409;

(b)(ix) CDR-H1 as depicted in SEQ ID NO: 417, CDR-H2 as depicted in SEQ ID NO: 418, CDR-H3 as depicted in SEQ ID NO: 419, CDR-L1 as depicted in SEQ ID NO: 420, CDR-L2 as depicted in SEQ ID NO: 421 and CDR-L3 as depicted in SEQ ID NO: 422;

(b)(x) CDR-H1 as depicted in SEQ ID NO: 430, CDR-H2 as depicted in SEQ ID NO: 431, CDR-H3 as depicted in SEQ ID NO: 432, CDR-L1 as depicted in SEQ ID NO: 433, CDR-L2 as depicted in SEQ ID NO: 434 and CDR-L3 as depicted in SEQ ID NO: 435;

(b)(xi) CDR-H1 as depicted in SEQ ID NO: 443, CDR-H2 as depicted in SEQ ID NO: 444, CDR-H3 as depicted in SEQ ID NO: 445, CDR-L1 as depicted in SEQ ID NO: 446, CDR-L2 as depicted in SEQ ID NO: 447 and CDR-L3 as depicted in SEQ ID NO: 448;

(b)(xii) CDR-H1 as depicted in SEQ ID NO: 456, CDR-H2 as depicted in SEQ ID NO: 457, CDR-H3 as depicted in SEQ ID NO: 458, CDR-L1 as depicted in SEQ ID NO: 459, CDR-L2 as depicted in SEQ ID NO: 460 and CDR-L3 as depicted in SEQ ID NO: 461, (b)(xiii) CDR-H1 as depicted in SEQ ID NO: 482, CDR-H2 as depicted in SEQ ID NO: 483, CDR-H3 as depicted in SEQ ID NO: 484, CDR-L1 as depicted in SEQ ID NO: 485, CDR-L2 as depicted in SEQ ID NO: 486 and CDR-L3 as depicted in SEQ ID NO: 487;

(b)(xiv) CDR-H1 as depicted in SEQ ID NO: 495, CDR-H2 as depicted in SEQ ID NO: 496, CDR-H3 as depicted in SEQ ID NO: 497, CDR-L1 as depicted in SEQ ID NO: 498, CDR-L2 as depicted in SEQ ID NO: 499 and CDR-L3 as depicted in SEQ ID NO: 500; and (b)(xv) CDR-H1 as depicted in SEQ ID NO: 599, CDR-H2 as depicted in SEQ ID NO: 600, CDR-H3 as depicted in SEQ ID NO: 601, CDR-L1 as depicted in SEQ ID NO: 602, CDR-L2 as depicted in SEQ ID NO: 603 and CDR-L3 as depicted in SEQ ID NO: 604.

2. The antibody construct according to claim 1, wherein the first binding domain comprises a VH region selected from the group consisting of VH regions (a) as depicted in SEQ ID NO: 21, SEQ ID NO: 34, SEQ ID NO: 47, SEQ ID NO: 60, SEQ ID NO: 73, SEQ ID NO: 86, SEQ ID NO: 99, SEQ ID NO: 112, SEQ ID NO: 125, SEQ ID NO: 138, SEQ ID NO: 151, SEQ ID NO: 164, SEQ ID NO: 177, SEQ ID NO: 190, SEQ ID NO: 203, SEQ ID NO: 216, SEQ ID NO: 229, SEQ ID NO: 242, SEQ ID NO: 255, SEQ ID NO: 268, SEQ ID NO: 281, SEQ ID NO: 294, SEQ ID NO: 307, SEQ ID NO: 320, SEQ ID NO: 515, SEQ ID NO: 528, SEQ ID NO: 541, SEQ ID NO: 554, SEQ ID NO: 567, SEQ ID NO: 580 and SEQ ID NO: 593; and (b) as depicted in SEQ ID NO: 8, SEQ ID NO: 333, SEQ ID NO: 346, SEQ ID NO: 359, SEQ ID NO: 372, SEQ ID NO: 385, SEQ ID NO: 398, SEQ ID NO: 411, SEQ ID NO: 424, SEQ ID NO: 437, SEQ ID NO: 450, SEQ ID NO: 463, SEQ ID NO: 476, SEQ ID NO: 489, SEQ ID NO: 502 and SEQ ID NO: 606.

3. The antibody construct according to claim 1, wherein the first binding domain comprises a VL region selected from the group consisting of VL regions (a) as depicted in SEQ ID NO: 23, SEQ ID NO: 36, SEQ ID NO: 49, SEQ ID NO: 62, SEQ ID NO: 75, SEQ ID NO: 88, SEQ ID NO: 101, SEQ ID NO: 114, SEQ ID NO: 127, SEQ ID NO: 140, SEQ ID NO: 153, SEQ ID NO: 166, SEQ ID NO: 179, SEQ ID NO: 192, SEQ ID NO: 205, SEQ ID NO: 218, SEQ ID NO: 231, SEQ ID NO: 244, SEQ ID NO: 257, SEQ ID NO: 270, SEQ ID NO: 283, SEQ ID NO: 296, SEQ ID NO: 309, SEQ ID NO: 322, SEQ ID NO: 517, SEQ ID NO: 530, SEQ ID NO: 543, SEQ ID NO: 556, SEQ ID NO: 569, SEQ ID NO: 582 and SEQ ID NO: 595; and (b) as depicted in SEQ ID NO: 10, SEQ ID NO: 335, SEQ ID NO: 348, SEQ ID NO: 361, SEQ ID NO: 374, SEQ ID NO: 387, SEQ ID NO: 400, SEQ ID NO: 413, SEQ ID NO: 426, SEQ ID NO: 439, SEQ ID NO: 452, SEQ ID NO: 465, SEQ ID NO: 478, SEQ ID NO: 491, SEQ ID NO: 504 and SEQ ID NO: 608.

4. The antibody construct according to claim 1, wherein the first binding domain comprises a VH region and a VL region selected from the group consisting of:

(a) pairs of a VH region and a VL region as depicted in SEQ ID NO: 21+23, SEQ ID NO: 34+36, SEQ ID NO: 47+49, SEQ ID NO: 60+62, SEQ ID NO: 73+75, SEQ ID NO: 86+88, SEQ ID NO: 99+101, SEQ ID NO: 112+114, SEQ ID NO: 125+127, SEQ ID NO: 138+140, SEQ ID NO: 151+153, SEQ ID NO: 164+166, SEQ ID NO: 177+179, SEQ ID NO: 190+192, SEQ ID NO: 203+205, SEQ ID NO: 216+218, SEQ ID NO: 229+231, SEQ ID NO: 242+244, SEQ ID NO: 255+257, SEQ ID NO: 268+270, SEQ ID NO: 281+283, SEQ ID NO: 294+296, SEQ ID NO: 307+309, SEQ ID NO: 320+322, SEQ ID NO: 515+517, SEQ ID NO: 528+530, SEQ ID NO: 541+543, SEQ ID NO: 554+556, SEQ ID NO: 567+569, SEQ ID NO: 580+582 and SEQ ID NO: 593+595; and (b) pairs of a VH region and a VL region as depicted in SEQ ID NO: 8+10, SEQ ID NO: 333+335, SEQ ID NO: 346+348, SEQ ID NO: 359+361, SEQ ID NO: 372+374, SEQ ID NO: 385+387, SEQ ID NO: 398+400, SEQ ID NO: 411+413, SEQ ID NO: 424+426, SEQ ID NO: 437+439, SEQ ID NO: 450+452, SEQ ID NO: 463+465, SEQ ID NO: 476+478, SEQ ID NO: 489+491, SEQ ID NO: 502+504 and SEQ ID NO: 606+608.

5. The antibody construct according to claim 1, wherein the antibody construct is in a format selected from the group consisting of (scFv)2, scFv-single domain mAb, diabodies and oligomers of the foregoing formats.

6. The antibody construct according to claim 1, wherein the first binding domain comprises an amino acid sequence selected from the group consisting of those depicted in (a) SEQ ID NO: 25, SEQ ID NO: 38, SEQ ID NO: 51, SEQ ID NO: 64, SEQ ID NO: 77, SEQ ID NO: 90, SEQ ID NO: 103, SEQ ID NO: 116, SEQ ID NO: 129, SEQ ID NO: 142, SEQ ID NO: 155, SEQ ID NO: 168, SEQ ID NO: 181, SEQ ID NO: 194, SEQ ID NO: 207, SEQ ID NO: 220, SEQ ID NO: 233, SEQ ID NO: 246, SEQ ID NO: 259, SEQ ID NO: 272, SEQ ID NO: 285, SEQ ID NO: 298, SEQ ID NO: 311, SEQ ID NO: 324, SEQ ID NO: 519, SEQ ID NO: 532, SEQ ID NO: 545, SEQ ID NO: 558, SEQ ID NO: 571, SEQ ID NO: 584 and SEQ ID NO: 597; and (b) SEQ ID NO: 12, SEQ ID NO: 337, SEQ ID NO: 350, SEQ ID NO: 363, SEQ ID NO: 376, SEQ ID NO: 389, SEQ ID NO: 402, SEQ ID NO: 415, SEQ ID NO: 428, SEQ ID NO: 441, SEQ ID NO: 454, SEQ ID NO: 467, SEQ ID NO: 480, SEQ ID NO: 493, SEQ ID NO: 506 and SEQ ID NO: 610.

7. The antibody construct according to claim 1, wherein the second binding domain binds to human and Callithrix jacchus, Saguinus Oedipus or Saimiri sciureus CD3 epsilon.

8. The antibody construct according to claim 1, having the amino acid sequence selected from the group consisting of those depicted in (a) SEQ ID NO: 26, SEQ ID NO: 39, SEQ ID NO: 52, SEQ ID NO: 65, SEQ ID NO: 78, SEQ ID NO: 91, SEQ ID NO: 104, SEQ ID NO: 117, SEQ ID NO: 130, SEQ ID NO: 143, SEQ ID NO: 156, SEQ ID NO: 169, SEQ ID NO: 182, SEQ ID NO: 195, SEQ ID NO: 208, SEQ ID NO: 221, SEQ ID NO: 234, SEQ ID NO: 247, SEQ ID NO: 260, SEQ ID NO: 273, SEQ ID NO: 286, SEQ ID NO: 299, SEQ ID NO: 312, SEQ ID NO: 325, SEQ ID NO: 520, SEQ ID NO: 533, SEQ ID NO: 546, SEQ ID NO: 559, SEQ ID NO: 572, SEQ ID NO: 585, SEQ ID NO: 598, SEQ ID NOs 613-636 and 651-658, SEQ ID NOs 660-683 and 698-705, SEQ ID NOs: 707-730 and 745-752, SEQ ID NOs: 754-777 and 792-799, SEQ ID NOs: 801-824 and 839-846, SEQ ID NOs: 848-871 and 886-893, SEQ ID NOs: 895-918 and 933-940, SEQ ID NOs: 942-965 and 980-987, SEQ ID NOs: 989-1012 and 1027-1034, SEQ ID NOs: 1036-1059 and 1074-1081, SEQ ID NOs: 1083-1106 and 1121-1128, SEQ ID NOs: 1130-1153 and 1 168-1175, SEQ ID NOs: 1177-1200 and 1215-1222, SEQ ID NOs: 1224-1247 and 1262-1269, SEQ ID NOs: 1271-1294 and 1309-1316, SEQ ID NOs: 1318-1341 and 1356-1363, SEQ ID NOs: 1365-1388 and 1403-1410, SEQ ID NOs: 1412-1435 and 1450-1457, SEQ ID NOs: 1459-1482 and 1497-1504, SEQ ID NOs:1506-1529 and 1544-1551, SEQ ID NOs: 1553-1576 and 1591-1598, SEQ ID NOs: 1600-1623 and 1638-1645, SEQ ID NOs: 1647-1670 and 1685-1692, SEQ ID NOs: 1694-1717 and 1732-1739, SEQ ID NOs: 1741-1764 and 1779-1786, SEQ ID NOs: 1788-1811 and 1826-1833; and (b) SEQ ID NO: 13, SEQ ID NO: 338, SEQ ID NO: 351, SEQ ID NO: 364, SEQ ID NO: 377, SEQ ID NO: 390, SEQ ID NO: 403, SEQ ID NO: 416, SEQ ID NO: 429, SEQ ID NO: 442, SEQ ID NO: 455, SEQ ID NO: 468, SEQ ID NO: 481, SEQ ID NO: 494, SEQ ID NO: 507, SEQ ID NO: 611, SEQ ID NOs: 612 and 637-650, SEQ ID NOs: 659 and 684-697, SEQ ID NOs: 706 and 731-744, SEQ ID NOs: 753 and 778-791, SEQ ID NOs: 800 and 825-838, SEQ ID NOs: 847 and 872-885, SEQ ID NOs: 894 and 919-932, SEQ ID NOs: 941 and 966-979, SEQ ID NOs: 988 and 1013-1026, SEQ ID NOs: 1035 and 1060-1073, SEQ ID NOs: 1082 and 1107-1120, SEQ ID NOs: 1129 and 1154-1167, SEQ ID NOs: 1176 and 1201-1214, SEQ ID NOs: 1223 and 1248-1261, SEQ ID NOs: 1270 and 1295-1308, SEQ ID NOs: 1317 and 1342-1355, SEQ ID NOs: 1364 and 1389-1402, SEQ ID NOs: 1411 and 1436-1449, SEQ ID NOs: 1458 and 1483-1496, SEQ ID NOs: 1505 and 1530-1543, SEQ ID NOs: 1552 and 1577-1590, SEQ ID NOs: 1599 and 1624-1637, SEQ ID NOs: 1646 and 1671-1684, SEQ ID NOs: 1693 and 1718-1731, SEQ ID NOs: 1740 and 1765-1778, SEQ ID NOs: 1787 and 1812-1825.

9. A pharmaceutical composition comprising the antibody construct of claim 1 and a carrier, stabilizer, excipient, diluent, solubilizer, surfactant, emulsifier, preservative and/or adjuvant.

10. A kit comprising the antibody construct of claim 1 and a container or recipient.

11. A polynucleotide encoding the antibody construct of claim 1.

12. An isolated vector comprising the polynucleotide of claim 11.

13. An isolated host cell transformed or transfected with the polynucleotide of claim 11.

14. A process for producing an antibody construct, said process comprising culturing the host cell of claim 13 under conditions allowing the expression of the antibody construct.

* * * * *

UNITED STATES PATENT AND TRADEMARK OFFICE
CERTIFICATE OF CORRECTION

PATENT NO.         : 9,765,157 B2                                    Page 1 of 1
APPLICATION NO.    : 14/815861
DATED              : September 19, 2017
INVENTOR(S)        : Shouhua Xiao et al.

It is certified that error appears in the above-identified patent and that said Letters Patent is hereby corrected as shown below:

On the Title Page

Item (57), Line 4, "binds a" should be -- binds to --.

In the Claims

At Column 147, Line 7, "162," should be -- 162; --.

At Column 147, Line 38, "CDR-H1as" should be -- CDR-H1 as --.

At Column 148, Line 50, "344," should be -- 344; --.

At Column 149, Line 29, "461," should be -- 461; --.

At Column 151, Line 28, "1 168-1175," should be -- 1168-1175, --.

Signed and Sealed this
Twentieth Day of February, 2018

Andrei Iancu
*Director of the United States Patent and Trademark Office*